US012644145B2

(12) United States Patent
Chiu et al.

(10) Patent No.: US 12,644,145 B2
(45) Date of Patent: Jun. 2, 2026

(54) METHODS FOR DETECTING AND SEQUENCING A TARGET NUCLEIC ACID

(71) Applicant: The Regents of the University of California, Oakland, CA (US)

(72) Inventors: Charles Chiu, San Francisco, CA (US); Andrea Granados, San Francisco, CA (US); Jennifer A. Doudna, Berkeley, CA (US); Lucas B. Harrington, Berkeley, CA (US); Janice S. Chen, Berkeley, CA (US); Xianding Deng, San Francisco, CA (US)

(73) Assignee: The Regents of the University of California, Oakland, CA (US)

( * ) Notice: Subject to any disclaimer, the term of this patent is extended or adjusted under 35 U.S.C. 154(b) by 1388 days.

(21) Appl. No.: 17/319,907

(22) Filed: May 13, 2021

(65) Prior Publication Data

US 2021/0269858 A1     Sep. 2, 2021

Related U.S. Application Data

(63) Continuation of application No. PCT/US2019/062033, filed on Nov. 18, 2019.

(60) Provisional application No. 62/769,410, filed on Nov. 19, 2018.

(51) Int. Cl.

| | |
|---|---|
| *C12Q 1/68* | (2018.01) |
| *C12Q 1/6806* | (2018.01) |
| *C12Q 1/6869* | (2018.01) |
| *C12Q 1/689* | (2018.01) |
| *C12Q 1/70* | (2006.01) |

(52) U.S. Cl.
CPC ......... *C12Q 1/6806* (2013.01); *C12Q 1/6869* (2013.01); *C12Q 1/689* (2013.01); *C12Q 1/701* (2013.01)

(58) Field of Classification Search
None
See application file for complete search history.

(56) References Cited

U.S. PATENT DOCUMENTS

| | | | | | |
|---|---|---|---|---|---|
| 9,850,484 | B2 * | 12/2017 | Joung | ............... | C12N 15/1031 |
| 10,253,365 | B1 * | 4/2019 | Doudna | ............... | C12Q 1/6876 |
| 10,738,303 | B2 * | 8/2020 | Joung | ............... | C12N 15/1031 |
| 11,118,224 | B2 * | 9/2021 | Doudna | ..................... | C12N 9/22 |
| 11,447,824 | B2 * | 9/2022 | Doudna | ............... | C12Q 1/6876 |
| 2016/0208241 | A1 * | 7/2016 | Tsai | ..................... | C12Q 1/6869 |
| 2016/0362739 | A1 * | 12/2016 | Brown | ................ | C12Q 1/6869 |
| 2017/0088833 | A1 * | 3/2017 | Joung | ............... | C12N 15/1031 |
| 2018/0237770 | A1 * | 8/2018 | May | ..................... | A61K 38/465 |
| 2019/0211404 | A1 * | 7/2019 | Ponnaluri | ............ | C12Q 1/6869 |
| 2019/0241954 | A1 * | 8/2019 | Doudna | .................. | C12N 15/11 |
| 2019/0300935 | A1 * | 10/2019 | Crawford | .................. | C12N 9/22 |
| 2020/0299768 | A1 * | 9/2020 | Doudna | ................. | C12N 15/11 |
| 2020/0399697 | A1 * | 12/2020 | Doudna | ............... | C12Q 1/6823 |
| 2021/0010065 | A1 * | 1/2021 | Salk | ..................... | C12Q 1/6818 |
| 2021/0269858 | A1 * | 9/2021 | Chiu | ..................... | C12Q 1/701 |
| 2021/0388437 | A1 * | 12/2021 | Doudna | ............... | C12Q 1/6876 |
| 2023/0068726 | A1 * | 3/2023 | Doudna | ............. | C12N 15/1065 |
| 2023/0159986 | A1 * | 5/2023 | Chiu | .................... | C12Q 1/6895 |
| | | | | | 435/6.11 |

FOREIGN PATENT DOCUMENTS

| | | | | | |
|---|---|---|---|---|---|
| WO | WO-2016186953 | A1 * | 11/2016 | .......... | C12N 15/902 |
| WO | WO-2017059313 | A1 * | 4/2017 | ........ | C12N 15/1031 |
| WO | WO-2018227025 | A1 * | 12/2018 | ............. | C12N 15/11 |
| WO | WO-2019104058 | A1 * | 5/2019 | ............. | C12N 15/11 |
| WO | WO-2021050565 | A1 * | 3/2021 | .......... | C07K 14/195 |
| WO | WO-2021216868 | A1 * | 10/2021 | .......... | C12Q 1/6806 |

OTHER PUBLICATIONS

Gao et al., 2016. Type V CRISPR-Cas Cpf1 endonuclease employs a unique mechanism for crRNA-mediated target DNA recognition. Cell research, 26(8), pp. 901-913. (Year: 2016).*
Kim et al., 2016. A simple, flexible and high-throughput cloning system for plant genome editing via CRISPR-Cas system. Journal of integrative plant biology, 58(8), pp. 705-712. (Year: 2016).*
Pattanayak et al., 2013. High-throughput profiling of off-target DNA cleavage reveals RNA-programmed Cas9 nuclease specificity. Nature biotechnology, 31(9), pp. 839-843. (Year: 2013).*
Swarts et al., Structural basis for guide RNA processing and seed-dependent DNA targeting by CRISPR-Cas12a. Mol. Cell 66, 221-233.e4 (2017). (Year: 2017).*
Tang et al., 2017. A CRISPR-Cpf1 system for efficient genome editing and transcriptional repression in plants. Nature plants, 3(3), 17018, pp. 1-21. (Year: 2017).*
Tsai et al., Smith, M.L., 2017. Amplification-free, CRISPR-Cas9 targeted enrichment and SMRT sequencing of repeat-expansion disease causative genomic regions. BioRxiv, 203919, pp. 1-26. (Year: 2017).*
Tsai et al., 2017. CIRCLE-seq: a highly sensitive in vitro screen for genome-wide CRISPR-Cas9 nuclease off-targets. Nature methods, 14(6), pp. 607-614. (Year: 2017).*
Zetsche et al., 2015. Cpf1 is a single RNA-guided endonuclease of a class 2 CRISPR-Cas system. Cell 163, 759-771. (Year: 2015).*

(Continued)

*Primary Examiner* — Gary Benzion
*Assistant Examiner* — Olayinka A Oyeyemi
(74) *Attorney, Agent, or Firm* — Gavrilovich, Dodd & Lindsey LLP

(57) ABSTRACT

The present disclosure provides methods for characterizing a target DNA present in a sample. The methods involve contacting the sample with a type V CRISPR/Cas effector protein and one or more guide RNAs, where the contacting generates a cleavage product comprising a 5' overhang; and ligating a double-stranded nucleic acid adapter to the cleavage product, to generate a ligation product. The ligation product includes the target DNA, which can be sequenced. The sample can be subjected to one or more amplification steps prior to the contacting step, with primers that provide for amplification of nucleic acids of, e.g., specific pathogens, categories of pathogens, two or more different pathogens, or two or more different categories of pathogens.

32 Claims, 39 Drawing Sheets

Specification includes a Sequence Listing.

(56)                    References Cited

OTHER PUBLICATIONS

Chen et al., Apr. 27, 2018. CRISPR-Cas 12a target binding unleashes indiscriminate single-stranded DNase activity. Science, 360(6387), pp. 436-439. (Year: 2018).*

Gootenberg et al., Apr. 27, 2018. Multiplexed and portable nucleic acid detection platform with Cas13, Cas12a, and Csm6. Science, 360(6387), pp. 439-444 or pp. 1-6. (Year: 2018).*

Kim et al., Aug. 2016. A simple, flexible and high-throughput cloning system for plant genome editing via CRISPR-Cas system. Journal of integrative plant biology, 58(8), pp. 705-712. (Year: 2016).*

Li et al. (1), Epub Mar. 12, 2018. CRISPR-Cas12a has both cis-and trans-cleavage activities on single-stranded DNA. Cell research, 28(4), pp. 491-493. (Year: 2018).*

Li et al. (2), Epub Apr. 24, 2018. CRISPR-Cas12a-assisted nucleic acid detection. Cell Discovery, 4(20): pp. 1-4. (Year: 2018).*

Chen et al., "CRISPR-Cas12a target binding unleashes indiscriminate single-stranded DNase activity," Science, 360, No. 6387, pp. 436-439, Apr. 27, 2018 (ePub Feb. 15, 2018).

Young, Lee, International Search Report (corrected), PCT/US2019062033, United States Patent & Trademark Office, Apr. 24, 2020.

Young, Lee, Written Opinion, PCT/US2019062033, United States Patent & Trademark Office, Apr. 7, 2020.

* cited by examiner

| | V2-V3 | | | | V3-V4 | | | | V4-V5 | | | |
|---|---|---|---|---|---|---|---|---|---|---|---|---|
| LbCas12a-crRNA | + | + | + | + | + | + | + | + | + | + | + | + |
| T4 DNA ligase | - | - | + | + | - | - | + | + | - | - | + | + |
| clicker (+ phosphorylation) | - | + | + | - | - | + | + | - | - | + | + | - |
| clicker (- phosphorylation) | - | - | - | + | - | - | - | + | - | - | - | + |

FIG. 5

Table 2. crRNA and clicker sequences used in the study

| | |
|---|---|
| JSC1001_preV1crRNA-Lb | UAAUUUCUACUAAGUGUAGAUAUCAUGGCUCAGAUUGAACG |
| JSC1002_V2-V3crRNA-Lb | UAAUUUCUACUAAGUGUAGAUCAACCCGAAGGCCUUCUUCA |
| JSC1003_V3-V4crRNA-Lb | UAAUUUCUACUAAGUGUAGAUCGCCCAGUAAUUCCGAUUAA |
| JSC1004_V4-V5crRNA-Lb | UAAUUUCUACUAAGUGUAGAUCGGCGUGGACUACCAGGGUA |
| JSC1006_V5-V6crRNA2-Lb | UAAUUUCUACUAAGUGUAGAUAUUCGAUGCAACGCGAAGAA |
| JSC1007_V6-V7crRNA-Lb | UAAUUUCUACUAAGUGUAGAUACAACACGAGCUGACGACAG |
| JSC1344_universal clicker | AGCTGACGTGTACTCCAGCGTCTCATCTATGCGTCAGCAGAGAATTCTGCT |
| JSC1357_preV1 dA clicker | ccagCGTTCAGCAGAATCTCTGCTGACGCATAGATGAGACGCTGGAGTACACGTCAGCTA |
| JSC1358_V2-V3 dA clicker | gtaTGAAGAAGCAGAATCTCTGCTGACGCATAGATGAGACGCTGGAGTACACGTCAGCTA |
| JSC1359_V3-V4 dA clicker | cgTTAATCGAGCAGAATCTCTGCTGACGCATAGATGAGACGCTGGAGTACACGTCAGCTA |
| JSC1360_V4-V5 dA clicker | gaTACCCTAGCAGAATCTCTGCTGACGCATAGATGAGACGCTGGAGTACACGTCAGCTA |
| JSC1361_V5-V6 dA clicker | ggTTCTTCAGCAGAATCTCTGCTGACGCATAGATGAGACGCTGGAGTACACGTCAGCTA |
| JSC1362_V6-V7 dA clicker | tggCTGTCGAGCAGAATCTCTGCTGACGCATAGATGAGACGCTGGAGTACACGTCAGCTA |

FIG. 6A

*Alicyclobacillus acidoterrestris Cas12b*

```
      1 mavksikvkl rlddmpeira glwklhkevn agvryytewl sllrqenlyr
rspngdgeqe
     61 cdktaeecka ellerlrarq venghrgpag sddellqlar qlyellvpqa
igakgdaqgi
    121 arkflsplad kdavgglgia kagnkprwvr mreagepgwe eekekaetrk
sadrtadvlr
    181 aladfglkpl mrvytdsems svewkplrkg qavrtwdrdm fqqaiermms
weswngrvgq
    241 eyaklveqkn rfeqknfvgq ehlvhlvnql qqdmkeaspg leskeqtahy
vtgralrgsd
    301 kvfekwgkla pdapfdlyda eiknvqrrnt rrfgshdlfa klaepeygal
wredasfltr
    361 yavynsilrk lnhakmfatf tlpdatahpi wtrfdklggn lhqytflfne
fgerrhairf
    421 hkllkvengv arevddtvp ismseqldnl lprdpnepla lyfrdygaeq
hftgefggak
    481 iqcrrdqlah mhrrrgardv ylnvsvrvqs qseargerrp pyaavfrlvg
dnhrafvhfd
    541 klsdylaehp ddgklgsegl lsglrvmsvd lglrtsasis vfrvarkdel
kpnskgrvpf
    601 ffpikgndnl vavhersqll klpgeteskd lraireerqr tlrqlrtqla
ylrllvrcgs
    661 edvgrrersw aklieqpvda anhmtpdwre afenelqklk slhgicsdke
wmdavyesvr
    721 rvwrhmgkqv rdwrkdvrsg erpkirgyak dvvggnsieq ieylerqykf
lkswsffgkv
    781 sgqviraekg srfaitlreh idhakedrlk kladriimea lgyvyalder
gkgkwvakyp
    841 pcqlilleel seyqfnndrp psennqlmqw shrgvfqell nqaqvhdllv
gtmyaafssr
    901 fdartgapgi rcrrvparct qehnpepfpw wlnkfvveht ldacplradd
liptgegelf
    961 vspfsaeegd fhqihadlna aqnlqqrlws dfdisqirlr cdwgevdgel
vliprltgkr
   1021 tadsysnkvf ytntgvtyye rergkkrrkv faqeklseee aellveadea
reksvvlmrd
   1081 psgiinrgnw trqkefwsmv nqriegylvk qirsvplqd sacentgdi
```

FIG. 6B

*Alicyclobacillus contaminans Cas12b*

```
       1 mgfntaellr kveeemrkts vgfdtdnpfs hritrrairg wdriseawrr
lppdapesey
      61 ieafkdiqrk nprkigsepl fknlaapgvr sellnnpqvl itfakynelg
rqlakakqfa
     121 qktlphpvfh pvwvrydklg gnlhhyqiep avhandthkv kfsslllpqe
dgsyaevkdv
     181 tvslapslqf ptglvhpkvt tpprtglvtv mdeeagkpvv cyrdrghdal
vpvafggakl
     241 qfnrahlsag yrkgvlsagg ggsiyfnvtl dvqvpnerdv sktfsfsrdr
dlvslkaeel
     301 krymetkplg mpqvrmsvd lgvrygaais vfevkpfaev rkdklhypit
gcegfvaehe
     361 rsvilklpge gvrtagkqse rkqalaaira emsilrkwlr vsqvteedra
kavrgllede
     421 rgggwtmdpg edsdhqplqg flhearlavg elvnlvhlsp aeweravier
hrrleritas
     481 hlrvfqtmrk vwgkrrneda ahtggislah iehliqqrkl firwsthart
ygevrrlpkh
     541 egfakrlqkh tnhvkedrik kladmivmas rgyrfldkra rwvktrhapc
dlilfedlsr
     601 yrftmdrppt ensqlmnwsh rellktvkmq aalfgigvgt vpaaftsrfd
aqtgapqlrc
     661 krvtkqdkek tpfwliqfae itgvnvtnve pgqlipvdgg ewfvspkgpr
aadglkcvha
     721 dinaahnlqr rfwiprlpsv kcrryveaeg faavpsstaf mkvhgkgafv
svdgefyeyq
     781 kgrrvavnra drtsstlded egdigeemlv ssngagefvr mfydesgyvg
ygrwmdskvf
     841 wgkvrqivhr aiqdqvekra aargengats sr
```

FIG. 6C

*Desulfovibrio inopinatus Cas12b*

```
      1 mptrtinlkl vlgknpenat lrralfsthr lvnqatkrie eflllcrges
yrtvdnegke
     61 aeiprhavqe ealafakaaq rhngcistye dqeildvlrq lyerlvpsvn
enneagdaga
    121 anawvsplms aesegglsvy dkvldpppvw mklkeekapg weaasqiwiq
sdeggsllnk
    181 pgspprwirk lrsgqpwqdd fvsdqkkkqd eltkgnapli kqlkemgllp
lvnpffrhll
    241 dpegkgvspw drlavraava hfisweswnh rtraeynslk lrrdefeaas
defkddftll
    301 rqyeakrhst lksialadds npyrigvrsl rawnrvreew idkgateeqr
vtilsklqtq
    361 lrgkfgdpdl fnwlaqdrhv hlwsprdsvt plvrinavdk vlrrrkpyal
mtfahprfhp
    421 rwilyeapgg snlrqyaldc tenalhitlp llvddahgtw iekkirvpla
psgqiqdltl
    481 eklekkknrl yyrsgfqqfa glaggaevlf hrpymehder seesllerpg
avwfkltldv
    541 atqappnwld gkgrvrtppe vhhfktalsn kskhtrtlqp glrvlsvdlg
mrtfascsvf
    601 ellegkpetg rafpvaders mdspnklwak hersfkltlp getpsrkeee
ersiaraely
    661 alkrdiqrlk sllrlgeedn dnrrdalleq ffkgwgeedv vpgqafprsl
fqglgaapfr
    721 stpelwrqhc qtyydkaeac lakhisdwrk rtrprptsre mwyktrsyhg
gksiwmleyl
    781 davrklllsw slrgrtygai nrqdtarfgs lasrllhhln slkedriktg
adsivgaarg
    841 yiplphgkgw eqryepcqli lfedlaryrf rvdrprrens qlmqwnhrai
vaettmqael
    901 ygqiventaa gfssrfhaat qapgvrcrfl lerdfdndlp kpyllrelsw
mlgntkvese
    961 eeklrllsek irpgslvpwd gqegfatlhp krqtlcviha dmnaaqnlqr
rffgrcqeaf
   1021 rlvcqphgdd vlrlastpga rllgalqqle ngqgafelvr dmgstsqmnr
fvmkslgkkk
   1081 ikplqdnngd deledvlsvl peeddtgrit vfrdssgiff pcnvwipakq
fwpavramiw
   1141 kvmashslg
```

FIG. 6D

*Desulfonatronum thiodismutans Cas12b*

```
    1 mvlgrkddta elrralwtth ehvnlavaev ervllrcrgr sywtldrrgd
pvhvpesqva
   61 edalamarea qrrngwpvvg edeelllair ylyeqivpsc llddlgkplk
gdagkiqtny
  121 agplfdsdtc rrdegkdvac cgpfhevagk ylgalpewat piskqefdgk
dashlrfkat
  181 ggddaffrvs iekanawyed panqdalknk aynkddwkke kdkgisswav
kyiqkqlglg
  241 qdprtevrrk lwlelgllpl fipvfdktmv gnlwnrlavr lalahllswe
swnhravgdq
  301 alarakrdel aalflgmedg faglreyelr rnesikqhaf epvdrpyvvs
gralrswtrv
  361 reewlrhgdt qesrknicnr lqdrlrgkfg dpdvfhwlae dgqealwker
dcvtsfslln
  421 dadgllekrk gyalmtfada rlhprwamye apggsnlrty qirktenglw
advvllsprn
  481 esaaveektf nvrlapsgql snvsfdqigk gskmvgrcry qsanqqfegl
lggaeilfdr
  541 krianeqhga tdlaskpghv wfkltldvrp qapqgwldgk grpalppeak
hfktalsnks
  601 kfadqvrpgl rvlsvdlgvr sfaacsvfel vrggpdqgty fpaadgrtvd
dpeklwakhe
  661 rsfkitlpge npsrkeeiar raameelrsl ngdirrikai lrlsvlqedd
prtehlrlfm
  721 eaivddpaks alnaelfkgf gddrfrstpd lwkqhchffh dkaekvvaer
fsrwrtetrp
  781 kssswqdwre rrgyaggksy wavtyleavr glilrwnmrg rtygevnrqd
kkqfgtvasa
  841 llhhinqlke driktgadmi iqaargfvpr kngagwvqvh epcrlllfed
laryrfrtdr
  901 srrensrlmr wshreivnev gmqgelyglh vdtteagfss rylassgapg
vrcrhlveed
  961 fhdglpgmhl vgeldwllpk dkdrtanear rllggmvrpg mlvpwdggel
fatlnaasgl
 1021 hvihadinaa qnlqrrfwgr cgeairivcn qlsvdgstry emakapkarl
lgalqqlkng
 1081 dapfhltsip nsqkpensyv mtptnagkky ragpgekssg eedelaldiv
eqaeelaggr
 1141 ktffrdpsgv ffapdrwlps eiywsrirrr iwqvtlerns sgrqeraemd
empy
```

FIG. 6E

*Opitutaceae bacterium TAV5* Cas12b

```
   1 mslnriyqgr vaavetqtal akgnvewmpa aggdevlwqh helfqaainy
ylvallalad
  61 knnpvlgpli sqmdnpqspy hvwgsfrrqg rqrtglsqav apyitpgnna
ptldevfrsi
 121 lagnptdrat ldaalmqllk acdgagaiqq egrsywpkfc dpdstanfag
dpamlrreqh
 181 rlllpqvlhd paithdspal gsfdtysiat pdtrtpqltg pkararlega
itlwrvrlpe
 241 saadfdrlas slkkipddds rlnlqgyvgs sakgevqarl falllfrhle
rssftlgllr
 301 satpppknae tpppagvplp aasaadpvrl argkrsfvfr aftslpcwhg
gdnihptwks
 361 fdlaafkyal tvinqieekt kerqkecael etdfdymhgr lakipvkytt
geaepppila
 421 ndlripllre llqnikvdta ltdgeavsyg lqrrtirgfr elrriwrgha
pagtvfssel
 481 keklagelrq fqtdnsttlg svqlfneliq npkywpiwqa pdvetarqwa
dagfaddpla
 541 alvqeaelqe didalkapvk ltpadpeysr rqydfnavsk fgagsrsanr
hepgqtergh
 601 ntfttelaar naadgnrwra thvrihysap rllrdglrrp dtdgnealea
vpwlqpmmea
 661 laplptlpqd ltgmpvflmp dvtlsgerri llnlpvtlep aalveqlgna
grwqnqffgs
 721 redpfalrwp adgavktakg kthipwhqdr dhftvlgvdl gtrdagalal
lnvtacpak
 781 pvhrligead grtwyaslad armirlpged arlfvrgklv qepygergrn
asllewedar
 841 niilrlgqnp dellgadprr hsypeindkl lvalrraqar larlqnrswr
lrdlaesdka
 901 ldeihaerag ekpsplppla rddaikstde allsqrdlir rsfvqianli
lplrgrrwew
 961 rphvevpdch ilaqsdpgtd dtkrlvaqgr gisherieqi eelrrrcqsl
nralrhkpge
1021 rpvlqrpakg eeiadpcpal lekinrlrdq rvdqtahail aaalgvrlra
pskdraerrh
1081 rdihgeyerf rapadfvvie nlsrylssqd rarsentrlm qwchrqivqk
lrqlcetygi
1141 pvlavpaays srfssrdgsa gfravhltpd hrhrmpwsri larlkaheed
gkrlektvld
1201 earavrglfd rldrfnaghv pgkpwrtlla plpggpvfvp lgdatpmqad
lnaalnialr
1261 giaapdrhdi hhrlraenkk rilslrlgtq rekarwpgga pavtlstpnn
gaspedsdal
1321 pervsnlfvd lagvanferv tlegvsqkfa tgrglwasvk qrawnrvarl
netvtdnnrn
1381 eeeddipm
```

FIG. 6F

Tuberibacillus calidus Cas12b

```
      1 matksfilkm ktknnpqlrl slwkthelfn fgvayymdll slfrqkdlym
hndedpdhpv
     61 vlkkeelqer lwmkvretqg kngfhgevsk devletlral yeelvpsavg
ksgeanqlsn
    121 kylypltdpa sqsgkgtans grkprwkklk eagdpswkda yekwekerqe
dpklkilaal
    181 qsfgliplfr pftendhkav isvkwmpksk nqsvrkfdkd mfnqaierfl
sweswnekva
    241 edyektvsiy eslqkelkgl stkafelmer vekayeahlr eltfsnstyr
ignrairgwt
    301 eivkkwmkld psapqgnyld vvkdyqrrhp resgdfklfe llsrpenqaa
wreypeflpl
    361 yvkyrhaegr mktakkqatf tlcdpirhpl wvryeersgt nlnkyrlimn
ekekvvqfdr
    421 liclnadghy eeqedtvpl apsqqfddqi kfssedtgkg khnfsyyhkg
inyelkqtlg
    481 gariqfdreh llrrggvkag nvgriflnvt lniepmqpfs rsgnlqtsvg
kalkvyvdgy
    541 pkvvnfkpke ltehikesek ntltlgvesl ptglrvmsvd lgqrqaaais
ifevvsekpd
    601 dnklfypvkd tdlfavhrts fniklpgekr terrmleqqk rdgairdlsr
klkflknvln
    661 mgklektder ekrvnrwikd rereeenpvy vqefemiskv lysphsvwvd
qlksihrkle
    721 eqlgkeiskw rqsisqgrqg vygislknie diektrrllf rwsmrpenpg
evkqlqpqer
    781 faidqqnhln hlkddrikkl anqivmtalg yrydgkrkkw iakhpacqlv
lfedlsryaf
    841 ydersrlenr nlmrwsrrei pkqvaqiggl ygllvgevga qyssrfhaks
gapgircrvv
    901 kehelylteg gqkvrnqkfl dslvennlie pddarrlepg dlirdqggdk
fatldergel
    961 vithadinaa qnlqkrfwtr thglyrirce srelkdavvl vpsdkdqkek
menlfgigyl
   1021 qpfkqendvy kwvkgekikg kktssqsddk elvseilqea svmadelkgn
rktlfrdpsg
   1081 yvfpkdrwyt ggryfgtleh llkrklaerr lfdggssrrg lfngtdsntn
ve
```

FIG. 6G

*Methylobacterium nodulans* Cas12b

```
      1 mltkqdkqgk ityctnmmev feaklgsadl llnwdhlrgr irdrvdagdi
gsaflklald
     61 vahvlpdgvd dqlaraafhf qsakgakskh adsvqaglrv lsidlgvrsf
atcsvfelkd
    121 tapttgvafp laefrlwavh ersftlelpg envgaagqqw raqadaelrq
lrgglnrhrq
    181 llraatvqkg erdayltdlr eawsakelwp feasllsele rcstvadplw
qdtckraarl
    241 yrtefgavvs ewrsrtrsre drkyagksmw svqhltdvrr flqswslagr
asgdirrldr
    301 erggvfakdl ldhidalkdd rlktgadliv qaargfqrne fgywvqkhap
chvilfedls
    361 ryrmrtdrpr rensqlmqwa hrgvpdmvgm qgeiygiqdr rdpdsarkha
rqplaafcld
    421 tpaafssryh astmtpgirc hplrkrefed qgflellkre negldlngyk
pgdlvplpgg
    481 evfvclnang lsrihadlna aqnlqrrfwt qhgdafrlpc gksavqgqir
waplsmgkrq
    541 agalggfgyl eptghdsgsc qwrktteaew rrlsgaqkdr deaaaaedee
lqgleeelle
    601 rsgervvffr dpsgvvlptd lwfpsaafws ivraktvgrl rshldaqaea
syavaagl
```

FIG. 6H

*Brevibacillus sp. CF112 Cas12b*

```
      1 mpkilrghkw islleqyeen rerelrenmt aandkyritk rqmkgwnely
elwstfpasa
     61 sheqykealk rvqqrlrgrf gdahffqylm eeknrliwkg npqrihyfva
rneltkrlee
    121 akqsatmtlp narkhplwvr fdarggnlqd yyltaeadkp rsrrfvtfsq
liwpsesgwm
    181 ekkdvevela lsrqfyqqvk llkndkgkqk iefkdkgsgs tfnghlggak
lqlergdlek
    241 eeknfedgei gsvylnvvid feplqevkng rvqapygqvl qlirrpnefp
kvttykseql
    301 vewlkaspqh sagveslasg frvmsidlgl raaaatsifs veessdknaa
dfsywiegtp
    361 lvavhhrsym lrlpgeqvek qvmekrderf qlhqrvkfqi rvlaqimrma
nkqygdrwde
    421 ldslkqaveq kkspldqtdr tfwegivcdl tkvlprnead weqavvqihr
kaeeyvqkav
    481 qawrkrfaad erkgiaglsm wnieeleglr klliswsrrs rnpqevnrfe
rghtshqrll
    541 thiqnvkedr lkqlshaivm talgyvyder kqewcaeypa cqvilfenls
qyrsnldrst
    601 kenstlmkwa hrsipkyvhm qaepyglqig dvraeyssrf yaktgtpgir
ckkvrgqdlq
    661 grrfenlqkr lvneqfltee qvkqlrpgdi vpddsgelfm tltdgsgske
vvflqadina
    721 ahnlqkrfwq rynelfkvsc rvivrdeeey lvpktksvqa klgkqlfvkk
sdtawkdvyv
    781 wdsqaklkgk ttfteesesp eqledfqeii eeaeeakqty rtlfrdpsgv
ffpesvwypq
    841 kdfwqevkrk lygklrerfl tkar
```

FIG. 6I

*Bacillus sp. NSP2.1 Cas12b*

```
   1 mairsiklkl kthtgpeaqn lrkgiwrthr llnegvayym kmlllfrqes
tgerpkeelq
  61 eellchireq qqrnqadknt qalpldkale alrqlyellv pssvgqsgda
qiisrkflsp
 121 lvdpnseggk gtskagakpt wqkkkeandp tweqdyekwk krreedptas
vittleeygi
 181 rplfplytnt vtdlawlplq snqfvrtwdr dmlqqaierl lsweswnkrv
qeeyaklkek
 241 maqlneqleg gqewislleq yeenrerelr enmtaandky ritkrqmkgw
nelyelwstf
 301 pasasheqyk ealkrvqqrl rgrfgdahff qylmeeknrl iwkgnpqrih
yfvarneltk
 361 rleeakqsat mtlpnarkhp lwvrfdargg nlqdyyltae adkprsrrfv
tfsqliwpse
 421 sgwmekkdve velalsrqfy qqvkllkndk gkqkiefkdk gsqstfnghl
ggaklqlerg
 481 dlekeeknfe dgelgsvyln vvidfeplqe vkngrvqapy gqvlqlirrp
nefpkvttyk
 541 seqlvewika spqhsagves lasgfrvmsi dlglraaaat sifsveessd
knaadfsywi
 601 eqtplvavhq rsymlrlpqe qvekqvmekr derfqlhqrv kfqirvlaqi
mrmankqygd
 661 rwdeldslkq aveqkkspld qtdrtfwegi vcdltkvlpr neadweqavv
qihrkaeeyv
 721 gkavqawrkr faaderkgla qlsmwnieel eglrklllsw srrtrnpqev
nrferghtsh
 781 qrllthiqnv kedrlkqlsh aivmtalgyv yderkqewca eypacqvilf
enlsqyrsnl
 841 drstkenstl mkwahrsipk yvhmqaepyg iqlgdvraey ssrfyaktgt
pgirckkvrg
 901 qdlqgrrfen lqkrlvneqf lteeqvkqlr pgdlvpddsq elfmtltdgs
gskevvflqa
 961 dinaahnlqk rfwqrynelf kvscrvivrd eeeylvpktk svqaklgkgl
fvkksdtawk
1021 dvyvwdsqak lkgkttftee sespeqledf qeileeaeea kgtyrtlfrd
psgvffpesv
1081 wypqkdfwqe vkrklygklr erfltkar
```

FIG. 6J

*Desulfatirhabdium butyrativorans Cas12b*

```
   1 mplsnnppvt qraytlrlrg adpsdlswre alwhtheavn kgakvfgdwl
ltlrgqldht
  61 ladtkvkggk gkpdrdptpe erkarrilla lswlsveskl gapssyivas
gdepakdrnd
 121 nvvsaleell qsrkvaksel ddwkrdcsas lsaairddav wvnrskvfde
avksvgsslt
 181 reeawdmler ffgsrdaylt pmkdpedkss eteqedkakd lvqkagqwls
srygtsegad
 241 fcrmsdiygk laawadnasq ggsstvddlv selrqhfdtk eskatngldw
liglssytgh
 301 tpnpvhellr qntslnkshl ddlkkkantr aescksklgs kgqrpysdai
lndvesvcgf
 361 tyrvdkdgqp vsvadyskyd vdykwgtarh yifavmldha arrislahkw
ikraeaerhk
 421 feedakrian vpararewld sfckersvts gavepyrirr ravdgwkevv
aawsksdcks
 481 tedrlaaara lqddseidkf gdiqlfeala eddalcvwhk dqeatnepdf
qplidyslai
 541 eaefkkrqfk vpayrhpdel lhpvfcdfgk srwkinydvh knvqapfyrg
lcltlwtgse
 601 ikpvplcwqs krltrdlalg nnhrndaasa vtradrlgra asnvtksdmv
nitglfeqad
 661 wngrlqaprq qleaiavvrd nprlseqern lrmcgmiehi rwlvtfsvkl
qpqgpwcaya
 721 eqhglntnpq ywphadtnrd rkvharlilp rlpglrvlsv dlghryasac
avweavntet
 781 vkeacqnvgr dmpkehdlyl hikvkkqgig kqtevdkttI yrrigadtlp
dgrphpapwa
 841 rldrqflIkl qgeekdarea sneeiwalhq meckldrtkp lidrliasgw
gllkrqmarl
 901 dalkelgwip apdssenlsr edgeakdyre slavddlmfs avrtlrlalq
rhgnrarlay
 961 ylisevklrp ggiqeklden gridllqdal alwhelfssp gwrdeaakql
wdsriatlag
1021 ykapeengdn vsdvayrkkq qvyreqlrnv aktlsqdvit ckelsdawke
rwededgrwk
1081 kllrwfkdwv lpsgtqanna tirnvgglsl srlatitefr rkvqvgfftr
lrpdgtrhel
1141 geqfggktld alellreqrv kqlasriaea algiqseggk gwdggkrprq
rindsrfapc
1201 havvienlan yrpdetrtrl enrrlmtwsa skvhkylsea cqlnglylct
vsawytsrqd
1261 srtgapgirc qdvsvrefmq spfwrkqvkq aeakhdenkg darerflcel
nktwkaktpa
1321 ewkkagfvri plrggeifvs adskspsakg ibadlnaaan iglraltdpd
wpgkwwyvpc
1381 dpvsfeskmd yvkgcaavkv gqplrqpaqt nadgaasklr kgkknrtagt
skekvylwrd
1441 isafplesne igewketsay qndvqyrvir mlkehiksld nrtgdnveg
```

FIG. 6K

Lachnospiraceae bacterium ND2006 (LbCas12a)

MSKLEKFTNCYSLSKTLRFKAIPVGKTQENIDNKRLLVEDEKRAEDYKGVKKLLDRYYLSFINDVLHSIKLKNLNNYISLFRK

KTRTEKENKELENLEINLRKEIAKAFKGNEGYKSLFKKDIIETILPEFLDDKDEIALVNSFNGFTTAFTGFFDNRENMFSEEA

KSTSIAFRCINENLTRYISNMDIFEKVDAIFDKHEVQEIKEKILNSDYDVEDFFEGEFFNFVLTQEGIDVYNAIIGGFVTESGE

KIKGLNEYINLYNQKTKQKLPKFKPLYKQVLSDRESLSFYGEGYTSDEEVLEVFRNTLNKNSEIFSSIKKLEKLFKNFDEYSSA

GIFVKNGPAISTISKDIFGEWNVIRDKWNAEYDDIHLKKKAVVTEKYEDDRRKSFKKIGSFSLEQLQEYADADLSVVEKLK

EIIIQKVDEIYKVYGSSEKLFDADFVLEKSLKKNDAVVAIMKDLLDSVKSFENYIKAFFGEGKETNRDESFYGDFVLAYDILL

KVDHIYDAIRNYVTQKPYSKDKFKLYFQNPQFMGGWDKDKETDYRATILRYGSKYYLAIMDKKYAKCLQKIDKDDVNG

NYEKINYKLLPGPNKMLPKVFFSKKWMAYYNPSEDIQKIYKNGTFKKGDMFNLNDCHKLIDFFKDSISRYPKWSNAYDF

NFSETEKYKDIAGFYREVEEQGYKVSFESASKKEVDKLVEEGKLYMFQIYNKDFSDKSHGTPNLHTMYFKLLFDENNHG

QIRLSGGAELFMRRASLKKEELVVHPANSPIANKNPDNPKKTTTLSYDVYKDKRFSEDQYELHIPIAINKCPKNIFKINTEV

RVLLKHDDNPYVIGIDRGERNLLYIVVVDGKGNIVEQYSLNEIINNFNGIRIKTDYHSLLDKKEKERFEARQNWTSIENIKEL

KAGYISQVVHKICELVEKYDAVIALEDLNSGFKNSRVKVEKQVYQKFEKMLIDKLNYMVDKKSNPCATGGALKGYQITN

KFESFKSMSTQNGFIFYIPAWLTSKIDPSTGFVNLLKTKYTSIADSKKFISSFDRIMYVPEEDLFEFALDYKNFSRTDADYIKK

WKLYSYGNRIRIFRNPKKNNVFDWEEVCLTSAYKELFNKYGINYQQGDIRALLCEQSDKAFYSSFMALMSLMLQMRNSI

TGRTDVDFLISPVKNSDGIFYDSRNYEAQENAILPKNADANGAYNIARKVLWAIGQFKKAEDEKLDKVKIAISNKEWLEY

AQTSVKH (SEQ ID NO: //)

FIG. 6L

Acidaminococcus sp. BV3L6 (AsCas12a)

MTQFEGFTNLYQVSKTLRFELIPQGKTLKHIQEQGFIEEDKARNDHYKELKPIIDRIYKTYADQCLQLVQLDWENLSAAID
SYRKEKTEETRNALIEEQATYRNAIHDYFIGRTDNLTDAINKRHAEIYKGLFKAELFNGKVLKQLGTVTTTEHENALLRSFD
KFTTYFSGFYENRKNVFSAEDISTAIPHRIVQDNFPKFKENCHIFTRLITAVPSLREHFENVKKAIGIFVSTSIEEVFSFPFYN
QLLTQTQIDLYNQLLGGISREAGTEKIKGLNEVLNLAIQKNDETAHIIASLPHRFIPLFKQILSDRNTLSFILEEFKSDEEVIQS
FCKYKTLLRNENVLETAEALFNELNSIDLTHIFISHKKLETISSALCDHWDTLRNALYERRISELTGKITKSAKEKVQRSLKHE
DINLQEIISAAGKELSEAFKQKTSEILSHAHAALDQPLPTTLKKQEEKEILKSQLDSLLGLYHLLDWFAVDESNEVDPEFSAR
LTGIKLEMEPSLSFYNKARNYATKKPYSVEKFKLNFQMPTLASGWDVNKEKNNGAILFVKNGLYYLGIMPKQKGRYKAL
SFEPTEKTSEGFDKMYYDYFPDAAKMIPKCSTQLKAVTAHFQTHTTPILLSNNFIEPLEITKEIYDLNNPEKEPKKFQTAYA
KKTGDQKGYREALCKWIDFTRDFLSKYTKTTSIDLSSLRPSSQYKDLGEYYAELNPLLYHISFQRIAEKEIMDAVETGKLYLF
QIYNKDFAKGHHGKPNLHTLYWTGLFSPENLAKTSIKLNGQAELFYRPKSRMKRMAHRLGEKMLNKKLKDQKTPIPDT
LYQELYDYVNHRLSHDLSDEARALLPNVITKEVSHEIIKDRRFTSDKFFFHVPITLNYQAANSPSKFNQRVNAYLKEHPETP
IIGIDRGERNLIYITVIDSTGKILEQRSLNTIQQFDYQKKLDNREKERVAARQAWSVVGTIKDLKQGYLSQVIHEIVDLMIH
YQAVVVLENLNFGFKSKRTGIAEKAVYQQFEKMLIDKLNCLVLKDYPAEKVGGVLNPYQLTDQFTSFAKMGTQSGFLFY
VPAPYTSKIDPLTGFVDPFVWKTIKNHESRKHFLEGFDFLHYDVKTGDFILHFKMNRNLSFQRGLPGFMPAWDIVFEKN
ETQFDAKGTPFIAGKRIVPVIENHRFTGRYRDLYPANELIALLEEKGIVFRDGSNILPKLLENDDSHAIDTMVALIRSVLQM
RNSNAATGEDYINSPVRDLNGVCFDSRFQNPEWPMDADANGAYHIALKGQLLLNHLKESKDLKLQNGISNQDWLAYI
QELRN (SEQ ID NO: //)

FIG. 6M

Francisella novicida U112 (FnCas12a)

MSIYQEFVNKYSLSKTLRFELIPQGKTLENIKARGLILDDEKRAKDYKKAKQIIDKYHQFFIEEILSSVCISEDLLQNYSDVYFK

LKKSDDDNLQKDFKSAKDTIKKQISEYIKDSEKFKNLFNQNLIDAKKGQESDLILWLKQSKDNGIELFKANSDITDIDEALEI

IKSFKGWTTYFKGFHENRKNVYSSNDIPTSIIYRIVDDNLPKFLENKAKYESLKDKAPEAINYEQIKKDLAEELTFDIDYKTSE

VNQRVFSLDEVFEIANFNNYLNQSGITKFNTIIGGKFVNGENTKRKGINEYINLYSQQINDKTLKKYKMSVLFKQILSDTES

KSFVIDKLEDDSDVVTTMQSFYEQIAAFKTVEEKSIKETLSLLFDDLKAQKLDLSKIYFKNDKSLTDLSQQVFDDYSVIGTAV

LEYITQQIAPKNLDNPSKKEQELIAKKTEKAKYLSLETIKLALEEFNKHRDIDKQCRFEEILANFAAIPMIFDEIAQNKDNLA

QISIKYQNQGKKDLLQASAEDDVKAIKDLLDQTNNLLHKLKIFHISQSEDKANILDKDEHFYLVFEECYFELANIVPLYNKIR

NYITQKPYSDEKFKLNFENSTLANGWDKNKEPDNTAILFIKDDKYYLGVMNKKNNKIFDDKAIKENKGEGYKKIVYKLLP

GANKMLPKVFFSAKSIKFYNPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTLYWKALFDERNLQDVVYKLN

GEAELFYRKQSIPKKITHPAKEAIANKNKDNPKKESVFEYDLIKDKRFTEDKFFFHCPITINFKSSGANKFNDEINLLLKEKA

NDVHILSIDRGERHLAYYTLVDGKGNIIKQDTFNIIGNDRMKTNYHDKLAAIEKDRDSARKDWKKINNIKEMKEGYLSQV

VHEIAKLVIEYNAIVVFEDLNFGFKRGRFKVEKQVYQKLEKMLIEKLNYLVFKDNEFDKTGGVLRAYQLTAPFETFKKMGK

QTGIIYYVPAGFTSKICPVTGFVNQLYPKYESVSKSQEFFSKFDKICYNLDKGYFEFSFDYKNFGDKAAKGKWTIASFGSRLI

NFRNSDKNHNWDTREVYPTKELEKLLKDYSIEYGHGECIKAAICGESDKKFFAKLTSVLNTILQMRNSKTGTELDYLISPV

ADVNGNFFDSRQAPKNMPQDADANGAYHIGLKGLMLLGRIKNNQEGKKLNLVIKNEEYFEFVQNRNN (SEQ ID NO:

Porphyromonas macacae (PmCas12a)

MKTQHFFEDFTSLYSLSKTIRFELKPIGKTLENIKKNGLIRRDEQRLDDYEKLKKVIDEYHEDFIANILSSFSFSEEILQSYIQNL

SESEARAKIEKTMRDTLAKAFSEDERYKSIFKKELVKKDIPVWCPAYKSLCKKFDNFTTSLVPFHENRKNLYTSNEITASIPY

RIVHVNLPKFIQNIEALCELQKKMGADLYLEMMENLRNVWPSFVKTPDDLCNLKTYNHLMVQSSISEYNRFVGGYSTE

DGTKHQGINEWINIYRQRNKEMRLPGLVFLHKQILAKVDSSSFISDTLENDDQVFCVLRQFRKLFWNTVSSKEDDAASL

KDLFCGLSGYDPEAIYVSDAHLATISKNIFDRWNYISDAIRRKTEVLMPRKKESVERYAEKISKQIKKRQSYSLAELDDLLAH

YSEESLPAGFSLLSYFTSLGGQKYLVSDGEVILYEEGSNIWDEVLIAFRDLQVILDKDFTEKKLGKDEEAVSVIKKALDSALRL

RKFFDLLSGTGAEIRRDSSFYALYTDRMDKLKGLLKMYDKVRNYLTKKPYSIEKFKLHFDNPSLLSGWDKNKELNNLSVIF

RQNGYYYLGIMTPKGKNLFKTLPKLGAEEMFYEKMEYKQIAEPMLMLPKVFFPKKTKPAFAPDQSVVDIYNKKTFKTGQ

KGFNKKDLYRLIDFYKEALTVHEWKLFNFSFSPTEQYRNIGEFFDEVREQAYKVSMVNVPASYIDEAVENGKLYLFQIYNK

DFSPYSKGIPNLHTLYWKALFSEQNQSRVYKLCGGGELFYRKASLHMQDTTVHPKGISIHKKNLNKKGETSLFNYDLVKD

KRFTEDKFFFHVPISINYKNKKITNVNQMVRDYIAQNDDLQIIGIDRGERNLLYISRIDTRGNLLEQFSLNVIESDKGDLRT

DYQKILGDREQERLRRRQEWKSIESIKDLKDGYMSQVVHKICNMVVEHKAIVVLENLNLSFMKGRKKVEKSVYEKFER

MLVDKLNYLVVDKKNLSNEPGGLYAAYQLTNPLFSFEELHRYPQSGILFFVDPWNTSLTDPSTGFVNLLGRINYTNVGD

ARKFFDRFNAIRYDGKGNILFDLDLSRFDVRVETQRKLWTLTTFGSRIAKSKKSGKWMVERIENLSLCFLELFEQFNIGYR

VEKDLKKAILSQDRKEFYVRLIYLFNLMMQIRNSDGEEDYILSPALNEKNLQFDSRLIEAKDLPVDADANGAYNVARKGL

MVVQRIKRGDHESIHRIGRAQWLRYVQEGIVE (SEQ ID NO: //)

FIG. 60

Moraxella bovoculi 237 (MbCas12a)

MLFQDFTHLYPLSKTVRFELKPIDRTLEHIHAKNFLSQDETMADMHQKVKVILDDYHRDFIADMMGEVKLTKLAEFYDV

YLKFRKNPKDDELQKQLKDLQAVLRKEIVKPIGNGGKYKAGYDRLFGAKLFKDGKELGDLAKFVIAQEGESSPKLAHLAH

FEKFSTYFTGFHDNRKNMYSDEDKHTAIAYRLIHENLPRFIDNLQILTTIKQKHSALYDQIINELTASGLDVSLASHLDGYH

KLLTQEGITAYNTLLGGISGEAGSPKIQGINELINSHHNQHCHKSERIAKLRPLHKQILSDGMSVSFLPSKFADDSEMCQA

VNEFYRHYADVFAKVQSLFDGFDDHQKDGIYVEHKNLNELSKQAFGDFALLGRVLDGYYVDVVNPEFNERFAKAKTDN

AKAKLTKEKDKFIKGVHSLASLEQAIEHYTARHDDESVQAGKLGQYFKHGLAGVDNPIQKIHNNHSTIKGFLERERPAGE

RALPKIKSGKNPEMTQLRQLKELLDNALNVAHFAKLLTTKTTLDNQDGNFYGEFGVLYDELAKIPTLYNKVRDYLSQKPF

STEKYKLNFGNPTLLNGWDLNKEKDNFGVILQKDGCYYLALLDKAHKKVFDNAPNTGKSIYQKMIYKYLEVRKQFPKVF

FSKEAIAINYHPSKELVEIKDKGRQRSDDERLKLYRFILECLKIHPKYDKKFEGAIGDIQLFKKDKKGREVPISEKDLFDKINGI

FSSKPKLEMEDFFIGEFKRYNPSQDLVDQYNIYKKIDSNDNRKKENFYNNHPKFKKDLVRYYYESMCKHEEWEESFEFSK

KLQDIGCYVDVNELFTEIETRRLNYKISFCNINADYIDELVEQGQLYLFQIYNKDFSPKAHGKPNLHTLYFKALFSEDNLAD

PIYKLNGEAQIFYRKASLDMNETTIHRAGEVLENKNPDNPKKRQFVYDIIKDKRYTQDKFMLHVPITMNFGVQGMTIKE

FNKKVNQSIQQYDEVNVIGIDRGERHLLYLTVINSKGEILEQCSLNDITTASANGTQMTTPYHKILDKREIERLNARVGW

GEIETIKELKSGYLSHVVHQISQLMLKYNAIVVLEDLNFGFKRGRFKVEKQIYQNFENALIKKLNHLVLKDKADDEIGSYKN

ALQLTNNFTDLKSIGKQTGFLFYVPAWNTSKIDPETGFVDLLKPRYENIAQSQAFFGKFDKICYNADKDYFEFHIDYAKFT

DKAKNSRQIWTICSHGDKRYVYDKTANQNKGAAKGINVNDELKSLFARHHINEKQPNLVMDICQNNDKEFHKSLMYL

LKTLLALRYSNASSDEDFILSPVANDEGVFFNSALADDTQPQNADANGAYHIALKGLWLLNELKNSDDLNKVKLAIDNQ

TWLNFAQNR (SEQ ID NO: //)

FIG. 6P

Moraxella bovoculi AAX08_00205 (Mb2Cas12a)

MGIHGVPAALFQDFTHLYPLSKTVRFELKPIGRTLEHIHAKNFLSQDETMADMYQKVKVILDDYHRDFIADMMGEVKL

TKLAEFYDVYLKFRKNPKDDGLQKQLKDLQAVLRKESVKPIGSGGKYKTGYDRLFGAKLFKDGKELGDLAKFVIAQEGES

SPKLAHLAHFEKFSTYFTGFHDNRKNMYSDEDKHTAIAYRLIHENLPRFIDNLQILTTIKQKHSALYDQIINELTASGLDVSL

ASHLDGYHKLLTQEGITAYNRIIGEVNGYTNKHNQICHKSERIAKLRPLHKQILSDGMGVSFLPSKFADDSEMCQAVNEF

YRHYTDVFAKVQSLFDGFDDHQKDGIYVEHKNLNELSKQAFGDFALLGRVLDGYYVDVVNPEFNERFAKAKTDNAKAK

LTKEKDKFIKGVHSLASLEQAIEHHTARHDDESVQAGKLGQYFKHGLAGVDNPIQKIHNNHSTIKGFLERERPAGERALP

KIKSGKNPEMTQLRQLKELLDNALNVAHFAKLLTTKTTLDNQDGNFYGEFGVLYDELAKIPTLYNKVRDYLSQKPFSTEKY

KLNFGNPTLLNGWDLNKEKDNFGVILQKDGCYYLALLDKAHKKVFDNAPNTGKNVYQKMVYKLLPGPNKMLPKVFFA

KSNLDYYNPSAELLDKYAKGTHKKGDNFNLKDCHALIDFFKAGINKHPEWQHFGFKFSPTSSYRDLSDFYREVEPQGYQ

VKFVDINADYIDELVEQGKLYLFQIYNKDFSPKAHGKPNLHTLYFKALFSEDNLADPIYKLNGEAQIFYRKASLDMNETTIH

RAGEVLENKNPDNPKKRQFVYDIIKDKRYTQDKFMLHVPITMNFGVQGMTIKEFNKKVNQSIQQYDEVNVIGIDRGER

HLLYLTVINSKGEILEQRSLNDITTASANGTQVTTPYHKILDKREIERLNARVGWGEIETIKELKSGYLSHVVHQINQLMLK

YNAIVVLEDLNFGFKRGRFKVEKQIYQNFENALIKKLNHLVLKDKADDEIGSYKNALQLTNNFTDLKSIGKQTGFLFYVPA

WNTSKIDPETGFVDLLKPRYENIAQSQAFFGKFDKICYNTDKGYFEFHIDYAKFTDKAKNSRQKWAICSHGDKRYVYDKT

ANQNKGAAKGINVNDELKSLFARYHINDKQPNLVMDICQNNDKEFHKSLMCLLKTLLALRYSNASSDEDFILSPVANDE

GVFFNSALADDTQPQNADANGAYHIALKGLWLLNELKNSDDLNKVKLAIDNQTWLNFAQNR (SEQ ID NO: //)

FIG. 6Q

Moraxella bovoculi AAX11_00205 (Mb3Cas12a)

MGIHGVPAALFQDFTHLYPLSKTVRFELKPIGKTLEHIHAKNFLNQDETMADMYQKVKAILDDYHRDFIADMMGEVKL

TKLAEFYDVYLKFRKNPKDDGLQKQLKDLQAVLRKEIVKPIGNGGKYKAGYDRLFGAKLFKDGKELGDLAKFVIAQEGES

SPKLAHLAHFEKFSTYFTGFHDNRKNMYSDEDKHTAIAYRLIHENLPRFIDNLQILATIKQKHSALYDQIINELTASGLDVS

LASHLDGYHKLLTQEGITAYNTLLGGISGEAGSRKIQGINELINSHHNQHCHKSERIAKLRPLHKQILSDGMGVSFLPSKFA

DDSEVCQAVNEFYRHYADVFAKVQSLFDGFDDYQKDGIYVEYKNLNELSKQAFGDFALLGRVLDGYYVDVVNPEFNER

FAKAKTDNAKAKLTKEKDKFIKGVHSLASLEQAIEHYTARHDDESVQAGKLGQYFKHGLAGVDNPIQKIHNNHSTIKGFL

ERERPAGERALPKIKSDKSPEIRQLKELLDNALNVAHFAKLLTTKTTLHNQDGNFYGEFGALYDELAKIATLYNKVRDYLS

QKPFSTEKYKLNFGNPTLLNGWDLNKEKDNFGVILQKDGCYYLALLDKAHKKVFDNAPNTGKSVYQKMIYKLLPGPNK

MLPKVFFAKSNLDYYNPSAELLDKYAQGTHKKGDNFNLKDCHALIDFFKAGINKHPEWQHFGFKFSPTSSYQDLSDFYR

EVEPQGYQVKFVDINADYINELVEQGQLYLFQIYNKDFSPKAHGKPNLHTLYFKALFSEDNLVNPIYKLNGEAEIFYRKAS

LDMNETTIHRAGEVLENKNPDNPKKRQFVYDIIKDKRYTQDKFMLHVPITMNFGVQGMTIKEFNKKVNQSIQQYDEV

NVIGIDRGERHLLYLTVINSKGEILEQRSLNDITTASANGTQMTTPYHKILDKREIERLNARVGWGEIETIKELKSGYLSHVV

HQISQLMLKYNAIVVLEDLNFGFKRGRFKVEKQIYQNFENALIKKLNHLVLKDKADDEIGSYKNALQLTNNFTDLKSIGKQ

TGFLFYVPAWNTSKIDPETGFVDLLKPRYENIAQSQAFFGKFDKICYNADRGYFEFHIDYAKFNDKAKNSRQIWKICSHG

DKRYVYDKTANQNKGATIGVNVNDELKSLFTRYHINDKQPNLVMDICQNNDKEFHKSLMYLLKTLLALRYSNASSDEDF

ILSPVANDEGVFFNSALADDTQPQNADANGAYHIALKGLWLLNELKNSDDLNKVKLAIDNQTWLNFAQNR (SEQ ID

Thiomicrospira sp. XS5 (TsCas12a)

MGIHGVPAATKTFDSEFFNLYSLQKTVRFELKPVGETASFVEDFKNEGLKRVVSEDERRAVDYQKVKEIIDDYHRDFIEES

LNYFPEQVSKDALEQAFHLYQKLKAAKVEEREKALKEWEALQKKLREKVVKCFSDSNKARFSRIDKKELIKEDLINWLVA

QNREDDIPTVETFNNFTTYFTGFHENRKNIYSKDDHATAISFRLIHENLPKFFDNVISFNKLKEGFPELKFDKVKEDLEVDY

DLKHAFEIEYFVNFVTQAGIDQYNYLLGGKTLEDGTKKQGMNEQINLFKQQQTRDKARQIPKLIPLFKQILSERTESQSFI

PKQFESDQELFDSLQKLHNNCQDKFTVLQQAILGLAEADLKKVFIKTSDLNALSNTIFGNYSVFSDALNLYKESLKTKKAQ

EAFEKLPAHSIHDLIQYLEQFNSSLDAEKQQSTDTVLNYFIKTDELYSRFIKSTSEAFTQVQPLFELEALSSKRRPPESEDEG

AKGQEGFEQIKRIKAYLDTLMEAVHFAKPLYLVKGRKMIEGLDKDQSFYEAFEMAYQELESLIPIYNKARSYLSRKPFKAD

KFKINFDNNTLLSGWDANKETANASILFKKDGLYYLGIMPKGKTFLFDYFVSSEDSEKLKQRRQKTAEEALAQDGESYFE

KIRYKLLPGASKMLPKVFFSNKNIGFYNPSDDILRIRNTASHTKNGTPQKGHSKVEFNLNDCHKMIDFFKSSIQKHPEWG

SFGFTFSDTSDFEDMSAFYREVENQGYVISFDKIKETYIQSQVEQGNLYLFQIYNKDFSPYSKGKPNLHTLYWKALFEEAN

LNNVVAKLNGEAEIFFRRHSIKASDKVVHPANQAIDNKNPHTEKTQSTFEYDLVKDKRYTQDKFFFHVPISLNFKAQGVS

KFNDKVNGFLKGNPDVNIIGIDRGERHLLYFTVVNQKGEILVQESLNTLMSDKGHVNDYQQKLDKKEQERDAARKSWT

TVENIKELKEGYLSHVVHKLAHLIIKYNAIVCLEDLNFGFKRGRFKVEKQVYQKFEKALIDKLNYLVFKEKELGEVGHYLTAY

QLTAPFESFKKLGKQSGILFYVPADYTSKIDPTTGFVNFLDLRYQSVEKAKQLLSDFNAIRFNSVQNYFEFEIDYKKLTPKRK

VGTQSKWVICTYGDVRYQNRRNQKGHWETEEVNVTEKLKALFASDSKTTTVIDYANDDNLIDVILEQDKASFFKELLWL

LKLTMTLRHSKIKSEDDFILSPVKNEQGEFYDSRKAGEVVWPKDADANGAYHIALKGLWNLQQINQWEKGKTLNLAIKN

QDWFSFIQEKPYQE  (SEQ ID NO: //)

FIG. 6S

Butyrivibrio sp. NC3005 (BsCas12a)

MGIHGVPAAYYQNLTKKYPVSKTIRNELIPIGKTLENIRKNNILESDVKRKQDYEHVKGIMDEYHKQLINEALDNYMLPSL

NQAAEIYLKKHVDVEDREEFKKTQDLLRREVTGRLKEHENYTKIGKKDILDLLEKLPSISEEDYNALESFRNFYTYFTSYNKV

RENLYSDEEKSSTVAYRLINENLPKFLDNIKSYAFVKAAGVLADCIEEEEQDALFMVETFNMTLTQEGIDMYNYQIGKVN

SAINLYNQKNHKVEEFKKIPKMKVLYKQILSDREEVFIGEFKDDETLLSSIGAYGNVLMTYLKSEKINIFFDALRESEGKNVY

VKNDLSKTTMSNIVFGSWSAFDELLNQEYDLANENKKKDDKYFEKRQKELKKNKSYTLEQMSNLSKEDISPIENYIERISE

DIEKICIYNGEFEKIVVNEHDSSRKLSKNIKAVKVIKDYLDSIKELEHDIKLINGSGQELEKNLVVYVGQEEALEQLRPVDSLY

NLTRNYLTKKPFSTEKVKLNFNKSTLLNGWDKNKETDNLGILFFKDGKYYLGIMNTTANKAFVNPPAAKTENVFKKVDY

KLLPGSNKMLPKVFFAKSNIGYYNPSTELYSNYKKGTHKKGPSFSIDDCHNLIDFFKESIKKHEDWSKFGFEFSDTADYRDI

SEFYREVEKQGYKLTFTDIDESYINDLIEKNELYLFQIYNKDFSEYSKGKLNLHTLYFMMLFDQRNLDNVVYKLNGEAEVFY

RPASIAENELVIHKAGEGIKNKNPNRAKVKETSTFSYDIVKDKRYSKYKFTLHIPITMNFGVDEVRRFNDVINNALRTDDN

VNVIGIDRGERNLLYVVVINSEGKILEQISLNSIINKEYDIETNYHALLDEREDDRNKARKDWNTIENIKELKTGYLSQVVN

VVAKLVLKYNAIICLEDLNFGFKRGRQKVEKQVYQKFEKMLIEKLNYLVIDKSREQVSPEKMGGALNALQLTSKFKSFAEL

GKQSGIIYYVPAYLTSKIDPTTGFVNLFYIKYENIEKAKQFFDGFDFIRFNKKDDMFEFSFDYKSFTQKACGIRSKWIVYTN

GERIIKYPNPEKNNLFDEKVINVTDEIKGLFKQYRIPYENGEDIKEIIISKAEADFYKRLFRLLHQTLQMRNSTSDGTRDYIIS

PVKNDRGEFFCSEFSEGTMPKDADANGAYNIARKGLWVLEQIRQKDEGEKVNLSMTNAEWLKYAQLHLL          (SEQ ID

AacCas12b

MAVKSIKVKLRLDDMPEIRAGLWKLHKEVNAGVRYYTEWLSLLRQENLYRRSPNGDGEQECDKTAEECKAELLERLRA
RQVENGHRGPAGSDDELLQLARQLYELLVPQAIGAKGDAQQIARKFLSPLADKDAVGGLGIAKAGNKPRWVRMREAG
EPGWEEEKEKAETRKSADRTADVLRALADFGLKPLMRVYTDSEMSSVEWKPLRKGQAVRTWDRDMFQQAIERMMS
WESWNQRVGQEYAKLVEQKNRFEQKNFVGQEHLVHLVNQLQQDMKEASPGLESKEQTAHYVTGRALRGSDKVFEK
WGKLAPDAPFDLYDAEIKNVQRRNTRRFGSHDLFAKLAEPEYQALWREDASFLTRYAVYNSILRKLNHAKMFATFTLPD
ATAHPIWTRFDKLGGNLHQYTFLFNEFGERRHAIRFHKLLKVENGVAREVDDVTVPISMSEQLDNLLPRDPNEPIALYFR
DYGAEQHFTGEFGGAKIQCRRDQLAHMHRRRGARDVYLNVSVRVQSQSEARGERRPPYAAVFRLVGDNHRAFVHFD
KLSDYLAEHPDDGKLGSEGLLSGLRVMSVDLGLRTSASISVFRVARKDELKPNSKGRVPFFFPIKGNDNLVAVHERSQLLK
LPGETESKDLRAIREERQRTLRQLRTQLAYLRLLVRCGSEDVGRRERSWAKLIEQPVDAANHMTPDWREAFENELQKLK
SLHGICSDKEWMDAVYESVRRVWRHMGKQVRDWRKDVRSGERPKIRGYAKDVVGGNSIEQIEYLERQYKFLKSWSFF
GKVSGQVIRAEKGSRFAITLREHIDHAKEDRLKKLADRIIMEALGYVYALDERGKGKWVAKYPPCQLILLEELSEYQFNND
RPPSENNQLMQWSHRGVFQELINQAQVHDLLVGTMYAAFSSRFDARTGAPGIRCRRVPARCTQEHNPEPFPWWLN
KFVVEHTLDACPLRADDLIPTGEGEIFVSPFSAEEGDFHQIHADLNAAQNLQQRLWSDFDISQIRLRCDWGEVDGELVLI
PRLTGKRTADSYSNKVFYTNTGVTYYERERGKKRRKVFAQEKLSEEEAELLVEADEAREKSVVLMRDPSGIINRGNWTR
QKEFWSMVNQRIEGYLVKQIRSRVPLQDSACENTGDI (SEQ ID NO: //)

FIG. 6U crRNA repeat sequences

Figure 6U:
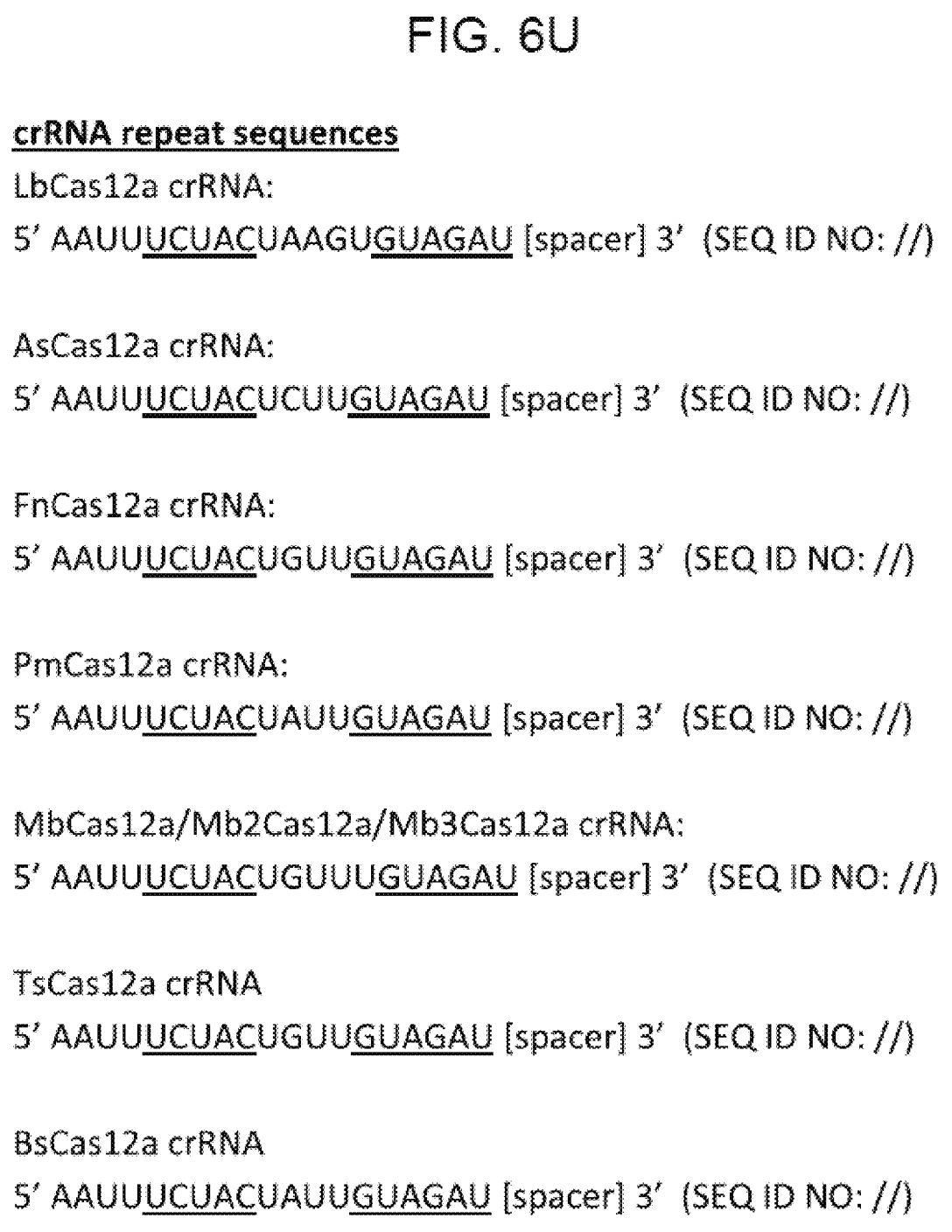

LbCas12a crRNA:

5' AAUU<u>UCUAC</u>UAAGU<u>GUAGAU</u> [spacer] 3'  (SEQ ID NO: //)

AsCas12a crRNA:

5' AAUU<u>UCUAC</u>UCUU<u>GUAGAU</u> [spacer] 3'  (SEQ ID NO: //)

FnCas12a crRNA:

5' AAUU<u>UCUAC</u>UGUU<u>GUAGAU</u> [spacer] 3'  (SEQ ID NO: //)

PmCas12a crRNA:

5' AAUU<u>UCUAC</u>UAUU<u>GUAGAU</u> [spacer] 3'  (SEQ ID NO: //)

MbCas12a/Mb2Cas12a/Mb3Cas12a crRNA:

5' AAUU<u>UCUAC</u>UGUUU<u>GUAGAU</u> [spacer] 3'  (SEQ ID NO: //)

TsCas12a crRNA

5' AAUU<u>UCUAC</u>UGUU<u>GUAGAU</u> [spacer] 3'  (SEQ ID NO: //)

BsCas12a crRNA

5' AAUU<u>UCUAC</u>UAUU<u>GUAGAU</u> [spacer] 3'  (SEQ ID NO: //)

FIG. 6V

AacCas12b single guide RNA (sgRNA)

5'
GUCUAGAGGACAGAAUUUUUCAACGGGUGUGCCAAUGGCCACUUUCCAGGUGGCAAAGCCCGU
UGAGCUUCUCAAAUCUGAGAAGUGGCAC [spacer] 3' (SEQ ID NO: //)

PAMs

LbCas12a PAM: 5'-TTTN-3'

AsCas12a PAM: 5'-TTTN-3'

FnCas12a PAM: 5'-TTTN-3'

PmCas12a PAM: 5'-TTN-3'

MbCas12a/Mb2Cas12a/Mb3Cas12a PAM: 5'-TTN-3'

TsCas12a PAM: 5'-TTN-3'

BsCas12a PAM: 5'-TTN-3'

AacCas12b PAM: 5'-TTN-3'

FIG. 7A

>CasX1
MEKRINKIRKKLSADNATKPVSRSGPMKTLLVRVMTDDLKKRLEKRRKKPEVMPQVISNNAANN
LRMLLDDYTKMKEAILQVYWQEFKDDHVGLMCKFAQPASKKIDQNLKPEMDEKGNLTTAGFAC
SQCGQPLFVYKLEQVSEKGKAYTNYFGRCNVAEHEKLILLAQLKPEKDSDEAVTYSLGKFGQRA
LDFYSIHVTKESTHPVKPLAQIAGNRYASGPVGKALSDACMGTIASFLSKYQDIIIEHQKVVKG
NQKRLESLRELAGKENLEYPSVTLPPQPHTKEGVDAYNEVIARVRMWVNLNLWQKLKLSRDDAK
PLLRLKGFPSFPVVERRENEVDWWNTINEVKKLIDAKRDMGRVFWSGVTAEKRNTILEGYNYLP
NENDHKKREGSLENPKKPAKRQFGDLLLYLEKKYAGDWGKVFDEAWERIDKKIAGLTSHIEREE
ARNAEDAQSKAVLTDWLRAKASFVLERLKEMDEKEFYACEIQLQKWYGDLRGNPFAVEAENRVV
DISGFSIGSDGHSIQYRNLLAWKYLENGKREFYLLMNYGKKGRIRFTDGTDIKKSGKWQGLLYG
GGKAKVIDLTFDPDDEQLIILPLAFGTRQGREFIWNDLLSLETGLIKLANGRVIEKTIYNKKIG
RDEPALFVALIFERREVVDPSNIKPVNLIGV<u>D</u>RGENIPAVIALTDPEGCPLPEFKDSSGGPTDI
LRIGEGYKEKQRAIQAAKEVEQRRAGGYSRK<u>F</u>ASKSRNLADDMVRNSARDLFYHAVTHDAVLVF
<u>E</u>NLSRGFGRQGKRTFMTERQYTKMEDWLTAKLAYEGLTSKTYLSKTLAQYTSKTCSNCGFTITT
ADYDGMLVRLKKTSDGWATTLNNKELKAEGQITYYNRYKRQTVEKELSAELDRLSEESGNNDIS
KWTKGRRDEALFLLKKRFSHRPVQEQFVCLDCGHEVHA<u>D</u>EQAALNIARSWLFLNSNSTEFKSYK
SGKQPFVGAWQAFYKRRLKEVWKPNA   (SEQ ID NO: //)

FIG. 7B

>CasX2

MQEIKRINKIRRRLVKDSNTKKAGKTGPMKTLLVRVMTPDLRERLENLRKKPENIPQPISNTSR
ANLNKLLTDYTEMKKAILHVYWEEFQKDPVGLMSRVAQPAPKNIDQRKLIPVKDGNERLTSSGF
ACSQCCQPLYVYKLEQVNDKGKPHTNYFGRCNVSEHERLILLSPHKPEANDELVTYSLGKFGQR
ALDFYSIHVTRESNHPVKPLEQIGGNSCASGPVGKALSDACMGAVASFLTKYQDIILEHQKVIK
KNEKRLANLKDIASANGLAFPKITLPPQPHTKEGIEAYNNVVAQIVIWVNLNLWQKLKIGRDEA
KPLQRLKGFPSFPLVERQANEVDWWDMVCNVKKLINEKKEDGKVFWQNLAGYKRQEALLPYLSS
EEDRKKGKKFARYQFGDLLLHLEKKHGEDWGKVVDEAWERIDKKVEGLSKHIKLEEERRSEDAQ
SKAALTDWLRAKASFVIEGLKEADKDEFCRCELKLQKWYGDLRGKPFAIEAENSILDISGFSKQ
YNCAFIWQKDGVKKLNLYLIINYFKGGKLRFKKIKPEAFEANRFYTVINKKSGEIVPMEVNENF
DDPNLIILPLAFGKRQGREFIWNDLLSLETGSLKLANGRVIEKTLYNRRTRQDEPALFVALTFE
RREVLDSSNIKPMNLIGIDRGENIPAVIALTDPEGCPLSRFKDSLGNPTHILRIGESYKEKQRT
IQAAKEVEQRRAGGYSRKYASKAKNLADDMVRNTARDLLYYAVTQDAMLIFENLSRGFGRQGKR
TFMAERQYTRMEDWLTAKLAYEGLPSKTYLSKTLAQYTSKTCSNCGFTITSADYDRVLEKLKKT
ATGWMTTINGKELKVECQITYYNRYKRQNVVKDLSVELDRLSEESVNNDISSWTKGRSGEALSL
LKKRFSHRPVQEKFVCLNCGFETHADEQAALNIARSWLFLRSQEYKKYQTNKTTGNTDKRAFVE
TWQSFYRKKLKEVWKPAV  (SEQ ID NO: //)

FIG. 8 unique ARDB genes

| aac2i | bl2e | ereb | mfpa | teta | vanxa |
|---|---|---|---|---|---|
| aac2ia | bl2f | erma | mpha | tetb | vanxb |
| aac2ib | bl3 | ermb | mphb | tetc | vanxd |
| aac2ic | ble | ermc | mphc | tetd | vph |
| aac2id | blt | ermd | msra | tete | |
| aac3ia | bmr | erme | norm | tetg | |
| aac3iia | cara | ermf | oleb | teth | |
| aac3iib | catal | ermg | opcm | tetj | |
| aac3iii | catal1 | ermh | opra | tetk | |
| aac3iv | catal2 | ermn | oprd | tetl | |
| aac3ix | catal3 | ermo | oprj | tetm | |
| aac3vi | catal4 | ermq | oprm | teto | |
| aac3vii | catal5 | ermr | oprn | tetpa | |
| aac3viii | catal6 | erms | otra | tetpb | |
| aac3x | cata2 | ermt | otrb | tetq | |
| aac6i | cata3 | ermu | pbpla | tets | |
| aac6ia | cata4 | ermv | pbplb | tett | |
| aac6ib | cata6 | ermw | pbp2 | tetu | |
| aac6ic | cata7 | ermx | pbp2b | tetv | |
| aac6ie | cata8 | fusb | pbp2x | tetw | |
| aac6if | cata9 | fush | pmra | tetx | |
| aac6ig | catbl | ksga | qac | tety | |
| aac6iia | catb2 | lmra | qaca | tetz | |
| aac6iib | catb3 | lmrb | qacb | tlrc | |
| aad9ib | catb5 | lnua | qnra | tmrb | |
| aadd | ceoa | lnub | qnrb | tolc | |
| acra | ceob | lsa | qnrs | tsnr | |
| acrb | cml | maca | rosa | vana | |

FIG. 8 (Cont.)

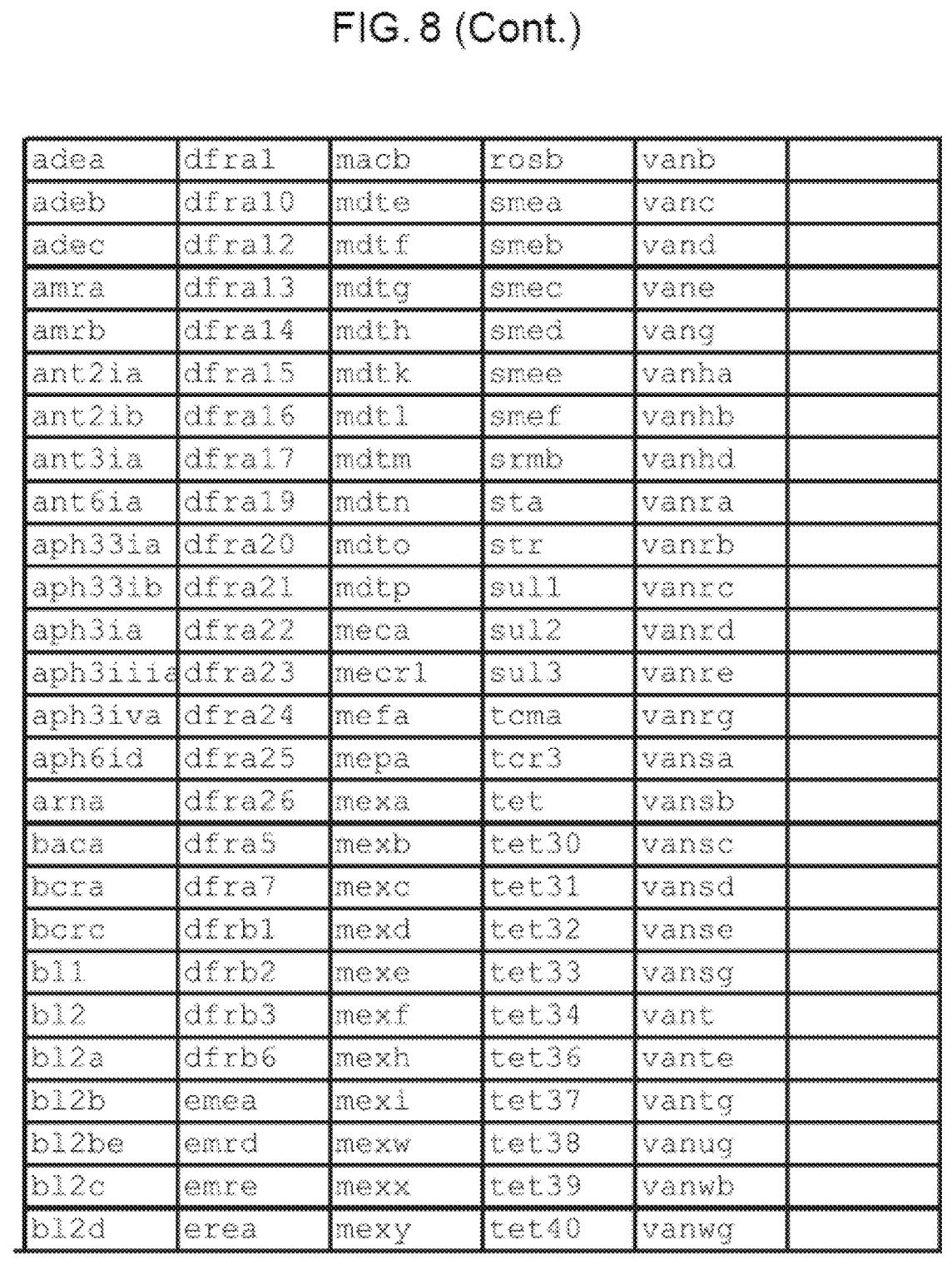

| adea | dfra1 | macb | rosb | vanb | |
|---|---|---|---|---|---|
| adeb | dfra10 | mdte | smea | vanc | |
| adec | dfra12 | mdtf | smeb | vand | |
| amra | dfra13 | mdtg | smec | vane | |
| amrb | dfra14 | mdth | smed | vang | |
| ant2ia | dfra15 | mdtk | smee | vanha | |
| ant2ib | dfra16 | mdtl | smef | vanhb | |
| ant3ia | dfra17 | mdtm | srmb | vanhd | |
| ant6ia | dfra19 | mdtn | sta | vanra | |
| aph33ia | dfra20 | mdto | str | vanrb | |
| aph33ib | dfra21 | mdtp | sul1 | vanrc | |
| aph3ia | dfra22 | meca | sul2 | vanrd | |
| aph3iiia | dfra23 | mecr1 | sul3 | vanre | |
| aph3iva | dfra24 | mefa | tcma | vanrg | |
| aph6id | dfra25 | mepa | tcr3 | vansa | |
| arna | dfra26 | mexa | tet | vansb | |
| baca | dfra5 | mexb | tet30 | vansc | |
| bcra | dfra7 | mexc | tet31 | vansd | |
| bcrc | dfrb1 | mexd | tet32 | vanse | |
| bl1 | dfrb2 | mexe | tet33 | vansg | |
| bl2 | dfrb3 | mexf | tet34 | vant | |
| bl2a | dfrb6 | mexh | tet36 | vante | |
| bl2b | emea | mexi | tet37 | vantg | |
| bl2be | emrd | mexw | tet38 | vanug | |
| bl2c | emre | mexx | tet39 | vanwb | |
| bl2d | erea | mexy | tet40 | vanwg | |

FIG. 11

| Virus | Viral titer (copies/ml)[a] | Primer type[b] | Viral RPM (ONT MinION nanopore) | # of reads | Fold change (ONT MinION nanopore)[c] | Viral RPM (Illumina MiSeq) | Fold Change (Illumina MiSeq)[d] |
|---|---|---|---|---|---|---|---|
| ZIKV | 10 | RH | 0 | 141,549 | | 0 | |
| ZIKV | 10 | ArboV-SP | 8 | 378,382 | >8.0 | 3.1 | >3.1 |
| ZIKV | 10 | RH | 0 | 131,662 | | 0.68 | |
| ZIKV | 10 | ArboV-SP | 28 | 393,179 | >28 | 11.2 | 16.4 |
| EBOV | 10 | RH | 1 | 810,439 | | 0.27 | |
| EBOV | 10 | EBOV-SP | 14 | 1,140,463 | 14 | 15 | 55 |
| EBOV | 10 | HFV-SP | 2 | 489,000 | 2.0 | 2 | 7.4 |
| EBOV | 100 | RH | 0 | 645,349 | | 8 | |
| EBOV | 100 | EBOV-SP | 108 | 608,429 | >108 | 130 | 16 |
| EBOV | 100 | HFV-SP | 31 | 386,053 | >31 | 53.6 | 6.7 |
| ZIKV | 100 | RH | 31 | 252,145 | | 16 | |
| ZIKV | 100 | ZIKV-SP | 341 | 259,154 | 11 | 247 | 15 |

FIG. 11 (Cont.)

| DENV | 100 | RH | 42 | 307,846 | | 38 | |
|---|---|---|---|---|---|---|---|
| DENV | 100 | DENV-SP | 82 | 763,017 | 1.5 | 199 | 5.2 |
| DENV | 100 | ArboV-SP | 103 | 202,737 | 2.5 | 141 | 3.7 |
| EBOV | 1,000 | RH | 216 | 244,554 | | 358 | |
| EBOV | 1,000 | EBOV-SP | 6,117 | 472,770 | 28 | 7,563 | 21 |
| ZIKV | 1,000 | RH | 208 | 125,000 | | 88 | |
| ZIKV | 1,000 | ZIKV-SP | 1,570 | 70,000 | 7.5 | 1,238 | 19 |
| ZIKV | 1,000 | ArboV-SP | 1,325 | 81,499 | 6.3 | 740.7 | 11 |
| DENV | 1,000 | RH | 322 | 433,949 | | 240 | |
| DENV | 1,000 | DENV-SP | 1,431 | 338,789 | 4.4 | 1,511 | 6.3 |
| DENV | 1,000 | ArboV-SP | 699 | 520,593 | 2.2 | 945 | 4.0 |

[a] determined by quantitative RT-PCR
[b] EBOV-SP/ZIKV-SP/ZIKV-SP/DENV-SP, target virus-specific spiked primers at 4 µM concentration and mixed with RH at 10:1 ratio; ArboV-SP, arbovirus panel spiked primers at 10 µM concentration; HFV-SP, hemorrhagic fever virus panel spiked primers at 20 µM concentration
[c] median fold change was 7.8
[d] median fold change was 9.2

Abbreviations: RPM, reads per million; ONT, Oxford Nanopore Technologies; RH, random hexamer; SP, spiked primers

FIG. 12

| Sample Type | Virus | Strain / subtype | Viral titer (copies/ml) | Primer type[a] | Fold enrichment | # of viral reads (RH primers)[b] | Genome coverage (RH primers)[b] | # of viral reads (spiked primers)[b] | Genome coverage (spiked primers) | % increase in coverage[c] |
|---|---|---|---|---|---|---|---|---|---|---|
| Viral Culture | ZIKV | Uganda MR766 | 100 | ZIKV-SP | 10.0 | 31 | 23.70% | 309 | 67.2% | 43.5% |
| | ZIKV | Uganda MR766 | 100 | ZIKV-SP | 15.4 | 13 | 4.30% | 200 | 44.3% | 40.0% |
| | ZIKV | Uganda MR766 | 1,000 | ZIKV-SP | 19.2 | 64 | 46.20% | 1229 | 95.6% | 49.4% |
| | HIV-1 | Group M, CRF01 | 100 | HIV-SP | 10.5 | 17 | 12.30% | 179 | 66.4% | 54.1% |
| | DENV | type 1 | 100 | DENV-SP | 5.2 | 69 | 29% | 359 | 80.9% | 51.9% |
| | DENV | type 1 | 1,000 | DENV-SP | 8.3 | 382 | 67.50% | 2411 | 97.2% | 30.0% |
| | EBOV | Ebola Kikwit-95 | 100 | EBOV-SP | 10.5 | 200 | 7.50% | 2095 | 84.9% | 77.4% |
| | EBOV | Ebola Kikwit-95 | 1,000 | EBOV-SP | 21.0 | 385 | 45.20% | 8095 | 90.3% | 45.1% |
| | Mean (SD) | | | | | | | | | 49 (±13.8)% |

FIG. 12 (Cont.)

| Clinical Serum Sample | | | | | | | | | |
|---|---|---|---|---|---|---|---|---|---|
| HIV | CRF01, #8 | 1,000 | HIV-SP | 6.0 | 55 | 21% | 330 | 92% | 71.0% |
| HIV | CRF01, #9 | 1,000 | HIV-SP | 3.1 | 76 | 44.80% | 234 | 83% | 38.2% |
| HIV | CRF01, #18 | 10,000 | HIV-SP | 2.6 | 138 | 67% | 358 | 88% | 21.0% |
| HIV | URF-0201, #22 | 1,000 | HIV-SP | 2.3 | 74 | 47.80% | 167 | 74.6% | 26.8% |
| HIV | URF-0122, #20 | 1,000 | HIV-SP | 8.8 | 11 | 13.50% | 97 | 81.4% | 47.9% |
| HCV | Genotype 2 | 1,000 | HCV-SP | 5.0 | 14 | 11.40% | 70 | 54% | 42.6% |
| HCV | Genotype 4 | 10,000 | HCV-SP | 1.7 | 411 | 33.30% | 707 | 82.6% | 49.5% |
| HCV | Genotype 6 | 1,000 | HCV-SP | 3.0 | 30 | 16.40% | 91 | 55% | 38.6% |
| Mean (SD) | | | | | | | | | 42% (±15.3%) |
| Overall mean % increase in coverage | | | | | | | | | 45.4% (±14.5%) | a EBOV-SP/ZIKV-SP/DENV-SP/HIV-SP/HCV-SP, target virus-specific spiked primers at 4 µM concentration and mixed with RH at 10:1 ratio b number of reads normalized by fold enrichment for purposes of comparison c using spiked primers relative to random hexamer primers only Abbreviations: RH, random hexamer; SP, spiked primers; CRF, HIV circulating recombinant form; URF, HIV unique recombinant form

FIG. 13

| Virus | Clinical sample type | Primer type[a] | # of preprocessed reads[b] | # of viral reads (RH primers) | Viral RPM (RH primers) | Genome coverage (RH primers) | # of viral reads (spiked primers) | Viral RPM (spiked primers) | Genome coverage (spiked primers) | % increase in coverage[c] | Fold change |
|---|---|---|---|---|---|---|---|---|---|---|---|
| Usutu | serum | ArboV-SP | 122,517,964 | 114 | 0.9 | 5.5% | 845 | 6.8 | 23.0% | 17.5 | 7.5 |
| SLEV | CSF | ZIKV-SP | 500,000 | 96 | 192 | 67.2% | 288 | 576 | 92.8% | 25.6 | 3 |
| Powassan | CSF | ArboV-SP | 11,268,014 | 88 | 7.8 | 39.6% | 1,007 | 114.6 | 82.6% | 43 | 14.7 | a ZIKV-SP, target virus-specific spiked primers at 4 μM concentration and mixed with RH at 10:1 ratio; ArboV-SP, arbovirus panel spiked primers at 10 μM concentration b same # of preprocessed reads analyzed from the RH and spiked primer runs for purposes of comparison c using spiked primers relative to random hexamer primers only Abbreviations: RH, random hexamer; RPM, reads per million; SLEV, St. Louis encephalitis virus; CSF, cerebrospinal fluid

METHODS FOR DETECTING AND SEQUENCING A TARGET NUCLEIC ACID

CROSS-REFERENCE

This application is a continuation of International Application No. PCT/US2019/062033, filed Nov. 18, 2019, which application claims the benefit of U.S. Provisional Patent Application No. 62/769,410, filed Nov. 19, 2018, which applications are incorporated herein by reference in their entirety.

STATEMENT REGARDING FEDERALLY SPONSORED RESEARCH

This invention was made with government support under 0950971 awarded by the National Science Foundation and under AI120977 and HL105704 awarded by the National Institutes of Health. The government has certain rights in the invention

INCORPORATION BY REFERENCE OF SEQUENCE LISTING

Accompanying this filing is a Sequence Listing entitled "Sequence-Listing_ST25.txt", created on Dec. 24, 2025 and having 6,425,783 bytes of data, machine formatted on IBM-PC, MS-Windows operating system. The sequence listing is hereby incorporated herein by reference in its entirety for all purposes.

INTRODUCTION

Bacterial adaptive immune systems employ CRISPRs (clustered regularly interspaced short palindromic repeats) and CRISPR-associated (Cas) proteins for RNA-guided nucleic acid cleavage. The CRISPR-Cas systems thereby confer adaptive immunity in bacteria and archaea via RNA-guided nucleic acid interference. To provide anti-viral immunity, processed CRISPR array transcripts (crRNAs) assemble with Cas protein-containing surveillance complexes that recognize nucleic acids bearing sequence complementarity to the virus derived segment of the crR-NAs, known as the spacer.

Class 2 CRISPR-Cas systems are streamlined versions in which a single Cas protein (an effector protein, e.g., a type V Cas effector protein such as Cpf1) bound to RNA is responsible for binding to and cleavage of a targeted sequence. The programmable nature of these minimal systems has facilitated their use as a versatile technology that continues to revolutionize the field of genome manipulation.

SUMMARY

The present disclosure provides methods for characterizing a target DNA present in a sample. The methods involve contacting the sample with a type V CRISPR/Cas effector protein and one or more guide RNAs, where the contacting step generates a cleavage product comprising a 5' overhang; and ligating a double-stranded nucleic acid adapter to the cleavage product, to generate a ligation product. The ligation product includes the target DNA, which can be sequenced. The sample can be subjected to one or more amplification steps prior to the contacting step, with primers that provide for amplification of nucleic acids of, e.g., specific pathogens, categories of pathogens, two or more different pathogens, or two or more different categories of pathogens.

BRIEF DESCRIPTION OF THE DRAWINGS

FIG. 5 provides Table 2, which provides examples of crRNA and clicker sequences (from top to bottom: SEQ ID NO:29 to 38, 17383, and 39 to 40 in order of appearance.

FIG. 6A-6V provide amino acid sequences of various Type V CRISPR/Cas effector proteins (depicted are Cas12b sequences) (FIG. 6A-6J; from top to bottom: SEQ ID NO:41 to SEQ ID NO:50); amino acid sequences of various Type V CRISPR/Cas effector proteins (depicted are Cas12a and Cas12b sequences) (FIG. 6K-6T; from top to bottom: SEQ ID NO:51 to SEQ ID NO:60); and example guide RNA sequences (e.g., crRNA repeat sequences and an example single guide RNA sequence) and example PAM sequences (FIG. 6U (SEQ ID NO:61 to 67) and FIG. 6V (SEQ ID NO:68)).

FIG. 7A-7B provide amino acid sequences of Type V CRISPR/Cas effector proteins (depicted are Cas12e sequences) (A) SEQ ID NO:69: (B) SEQ ID NO:7.

FIG. 8 provides a list of target antibiotic resistance genes.

FIG. 1A-10B provide an algorithm for primer design and a sequencing workflow.

FIG. 11 provides a table showing detection of targeted viruses using MSSPE.

FIG. 12 provides a table showing viral genome coverage using MSSPE.

FIG. 13 provides a table showing detection of untargeted emerging or novel viruses using MSSPE.

DEFINITIONS

Figure 1:
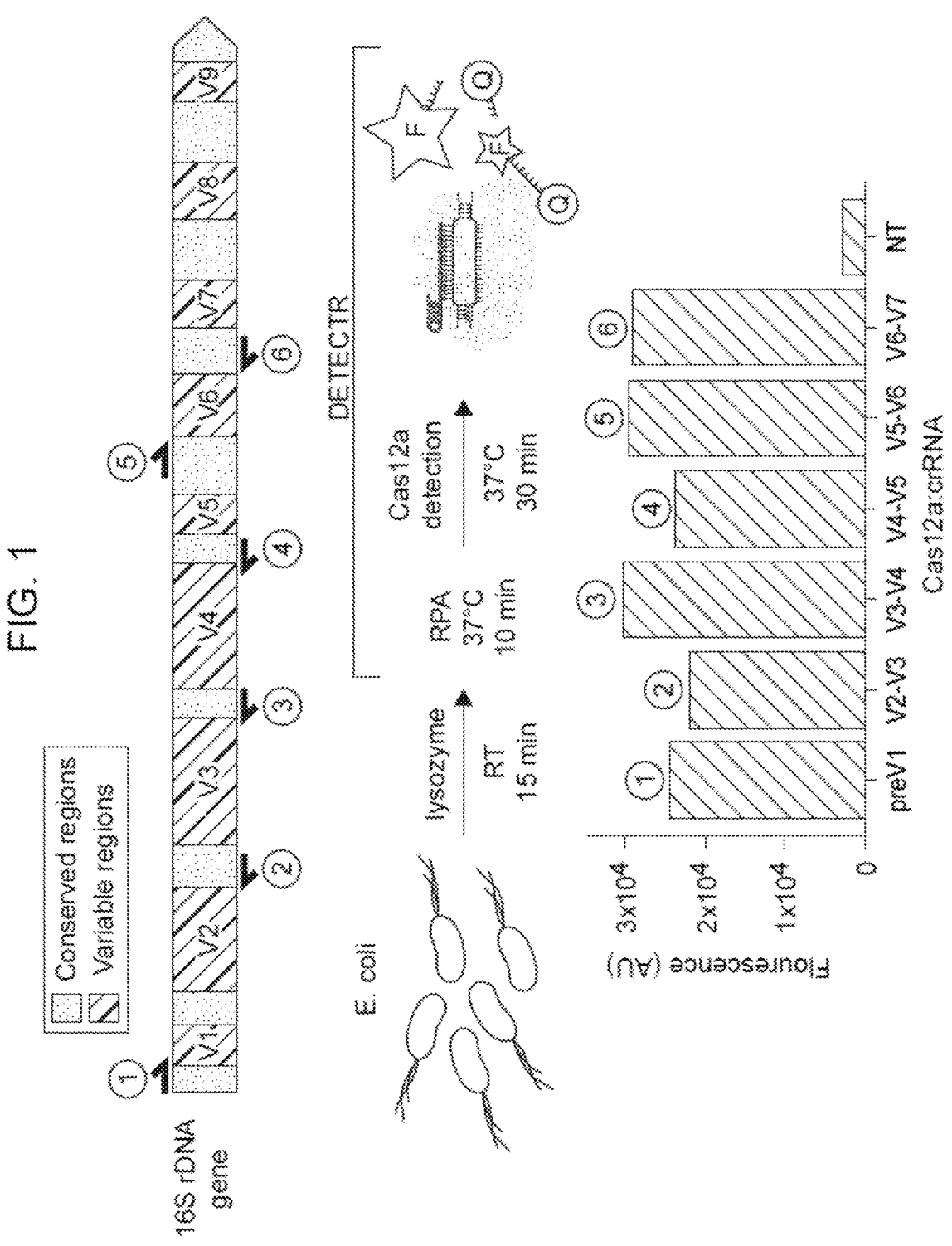
FIG. 1 depicts detection of *Escherichia coli* DNA using a Cas12a effector protein and guide RNAs targeting conserved regions of 16S rDNA. Using this system (referred to as "DETECTR", *E. coli* DNA can be detected within 30 minutes.
Figure 2:
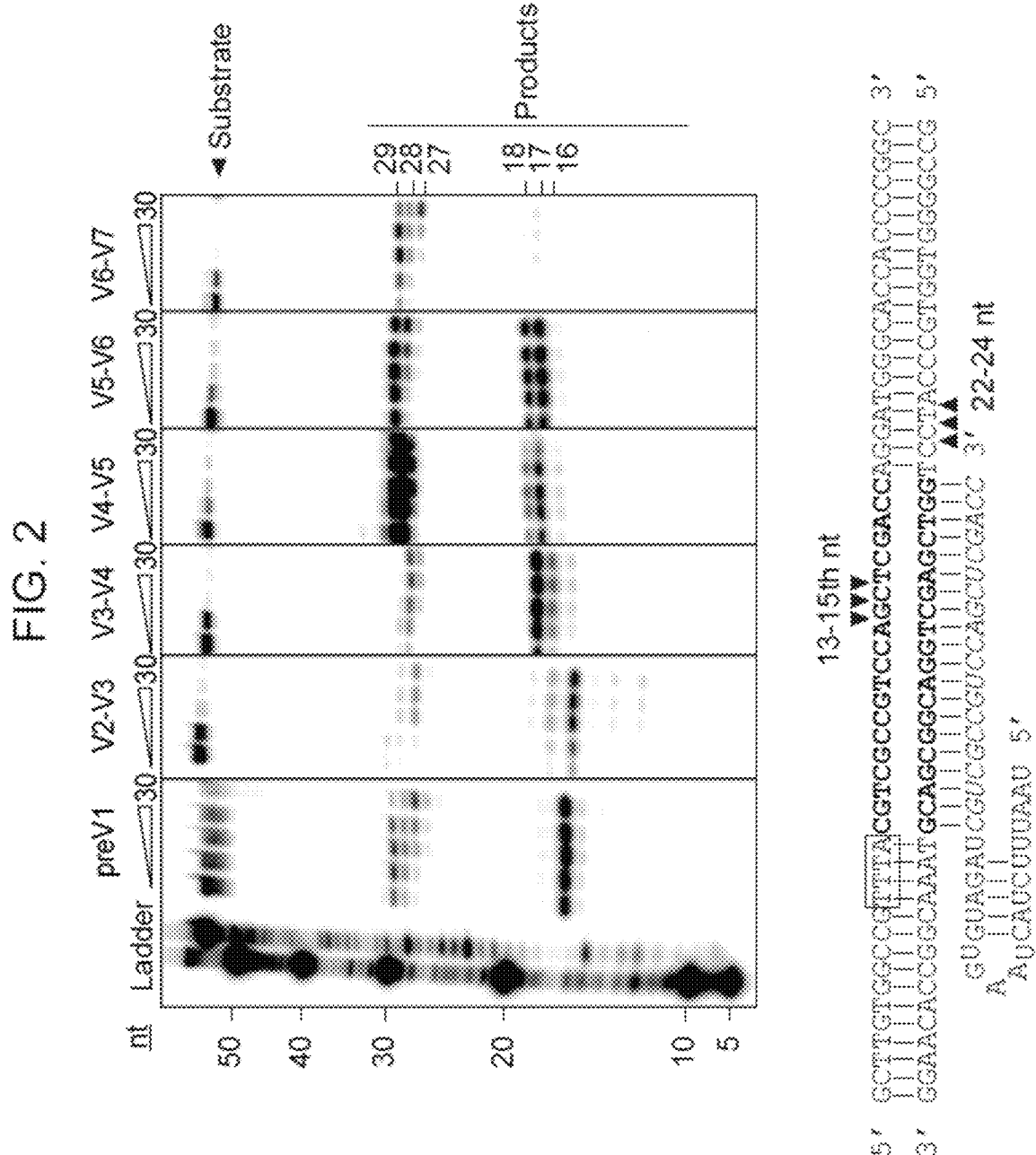
FIG. 2 depicts cleavage site mapping of 16S rDNA target sequences. Substrates were 5' radiolabelled and mapped on a denaturing polyacrylamide gel electrophoresis (PAGE) gel to identify cleavage sites. LbCas12a leaves an 8-10 nucleotide 5' overhang. (SEQ ID NO:19, 17379 and 17380 in order of appearance).

The terms "polynucleotide" and "nucleic acid," used interchangeably herein, refer to a polymeric form of nucleotides of any length, either ribonucleotides or deoxyribonucleotides. Thus, terms "polynucleotide" and "nucleic acid" encompass single-stranded DNA; double-stranded DNA; multi-stranded DNA; single-stranded RNA; double-stranded RNA; multi-stranded RNA; genomic DNA; cDNA; DNA-RNA hybrids; and a polymer comprising purine and pyrimidine bases or other natural, chemically or biochemically modified, non-natural, or derivatized nucleotide bases.

The term "oligonucleotide" refers to a polynucleotide of between 4 and 100 nucleotides of single- or double-stranded nucleic acid (e.g., DNA, RNA, or a modified nucleic acid). However, for the purposes of this disclosure, there is no upper limit to the length of an oligonucleotide. Oligonucleotides are also known as "oligomers" or "oligos" and can be isolated from genes, transcribed (in vitro and/or in vivo), or chemically synthesized. The terms "polynucleotide" and "nucleic acid" should be understood to include, as applicable to the embodiments being described, single-stranded (such as sense or antisense) and double-stranded polynucleotides.

By "hybridizable" or "complementary" or "substantially complementary" it is meant that a nucleic acid (e.g. RNA, DNA) comprises a sequence of nucleotides that enables it to non-covalently bind, i.e. form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. Standard Watson-Crick base-pairing includes: adenine/adenosine) (A) pairing with thymidine/thymidine T), A pairing with uracil/uridine (U), and guanine/guanosine) (G) pairing with cytosine/cytidine (C). In addition, for hybridization between two RNA molecules (e.g., dsRNA), and for hybridization of a DNA molecule with an RNA molecule (e.g., when a DNA target nucleic acid base pairs with a guide RNA, etc.): G can also base pair with U. For example, G/U base-pairing is partially responsible for the degeneracy (i.e., redundancy) of the genetic code in the context of tRNA anti-codon base-pairing with codons in mRNA. Thus, in the context of this disclosure, a G (e.g., of a protein-binding segment (e.g., dsRNA duplex) of a guide RNA molecule; of a target nucleic acid (e.g., target DNA) base pairing with a guide RNA) is considered complementary to both a U and to C. For example, when a G/U base-pair can be made at a given nucleotide position of a protein-binding segment (e.g., dsRNA duplex) of a guide RNA molecule, the position is not considered to be non-complementary, but is instead considered to be complementary.

Hybridization requires that the two nucleic acids contain complementary sequences, although mismatches between bases are possible. The conditions appropriate for hybridization between two nucleic acids depend on the length of the nucleic acids and the degree of complementarity, variables well known in the art. The greater the degree of complementarity between two nucleotide sequences, the greater the value of the melting temperature (Tm) for hybrids of nucleic acids having those sequences. Typically, the length for a hybridizable nucleic acid is 8 nucleotides or more (e.g., 10 nucleotides or more, 12 nucleotides or more, 15 nucleotides or more, 20 nucleotides or more, 22 nucleotides or more, 25 nucleotides or more, or 30 nucleotides or more).

It is understood that the sequence of a polynucleotide need not be 100% complementary to that of its target nucleic acid to be specifically hybridizable. Moreover, a polynucleotide may hybridize over one or more segments such that intervening or adjacent segments are not involved in the hybridization event (e.g., a loop structure or hairpin structure, a 'bulge', and the like). A polynucleotide can comprise 60% or more, 65% or more, 70% or more, 75% or more, 80% or more, 85% or more, 90% or more, 95% or more, 98% or more, 99% or more, 99.5% or more, or 100% sequence complementarity to a target region within the target nucleic acid sequence to which it will hybridize. For example, an antisense nucleic acid in which 18 of 20 nucleotides of the antisense compound are complementary to a target region, and would therefore specifically hybridize, would represent 90 percent complementarity. The remaining noncomplementary nucleotides may be clustered or interspersed with complementary nucleotides and need not be contiguous to each other or to complementary nucleotides. Percent complementarity between particular stretches of nucleic acid sequences within nucleic acids can be determined using any convenient method. Example methods include BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), e.g., using default settings, which uses the algorithm of Smith and Waterman (Adv. Appl. Math., 1981, 2, 482-489).

The terms "peptide," "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones.

"Binding" as used herein (e.g. with reference to an RNA-binding domain of a polypeptide, binding to a target nucleic acid, and the like) refers to a non-covalent interaction between macromolecules (e.g., between a protein and a nucleic acid; between a guide RNA and a target nucleic acid; and the like). While in a state of non-covalent interaction, the macromolecules are said to be "associated" or "interacting" or "binding" (e.g., when a molecule X is said to interact with a molecule Y, it is meant the molecule X binds to molecule Y in a non-covalent manner). Not all components of a binding interaction need be sequence-specific (e.g., contacts with phosphate residues in a DNA backbone), but some portions of a binding interaction may be sequence-specific. Binding interactions are generally characterized by a dissociation constant ($K_d$) of less than $10^{-6}$ M, less than $10^{-7}$ M, less than $10^{-8}$ M, less than $10^{-9}$ M, less than $10^{-10}$ M, less than $10^{-11}$ M, less than $10^{-12}$ M, less than $10^{-13}$ M, less than $10^{-14}$ M, or less than $10^{-15}$ M. "Affinity" refers to the strength of binding, increased binding affinity being correlated with a lower $K_d$.

By "binding domain" it is meant a protein domain that is able to bind non-covalently to another molecule. A binding domain can bind to, for example, an RNA molecule (an RNA-binding domain) and/or a protein molecule (a protein-binding domain). In the case of a protein having a protein-binding domain, it can in some cases bind to itself (to form homodimers, homotrimers, etc.) and/or it can bind to one or more regions of a different protein or proteins.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide containing side chains consisting of asparagine and glutamine; a group of amino acids having aromatic side chains consists of phenylalanine, tyrosine, and tryptophan; a group of amino acids having basic side chains consists of lysine, arginine, and histidine; a group of amino acids having acidic side chains consists of glutamate and aspartate; and a group of amino acids having sulfur containing side chains consists of cysteine and methionine. Exemplary conservative amino acid substitution groups are: valine-leucine-isoleucine, phenylalanine-tyrosine, lysine-arginine, alanine-valine-glycine, and asparagine-glutamine.

A polynucleotide or polypeptide has a certain percent "sequence identity" to another polynucleotide or polypeptide, meaning that, when aligned, that percentage of bases or amino acids are the same, and in the same relative position, when comparing the two sequences. Sequence identity can be determined in a number of different ways. To determine sequence identity, sequences can be aligned using various methods and computer programs (e.g., BLAST, T-COFFEE, MUSCLE, MAFFT, Phyre2, etc.), available over the world wide web at sites including ncbi.nlm.nili.gov/BLAST, ebi.ac.uk/Tools/msa/tcoffee/, ebi.ac.uk/Tools/msa/muscle/, maff.cbrc.jp/alignment/software/, http://www.sbg.bio.ic.a-c.uk/~phyre2/. See, e.g., Altschul et al. (1990), *J. Mol. Biol.* 215:403-10.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "a type V CRISPR/Cas effector polypeptide" includes a plurality of such polypeptides and reference to "the guide RNA" includes reference to one or more guide RNAs and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

The present disclosure provides methods for characterizing a target DNA that is present in a sample. The methods involve contacting the sample with a type V CRISPR/Cas effector protein and one or more guide RNAs, where the contacting step generates a protospacer-adjacent motif (PAM)-distal cleavage product comprising a 5' overhang; and ligating a double-stranded nucleic acid adapter to the cleavage product, to generate a ligation product. The double-stranded nucleic acid adapter comprises a 5' overhang that comprises a stretch of from 3 to 15 contiguous nucleotides that are complementary to a contiguous stretch of nucleotides of the same length in the 5' overhang of the PAM-distal cleavage product. The ligation product includes the target DNA, which can be sequenced. The sample can be subjected to one or more amplification steps prior to the contacting step, with primers that provide for amplification of nucleic acids of, e.g., specific pathogens, categories of pathogens, two or more different pathogens, or two or more different categories of pathogens. The pre-amplified sample can also be contacted with a ssDNA reporter molecule that provides a readout when the type V CRISPR/Cas effector contacts the target DNA. The present disclosure provides a kit comprising components for carrying out a method of the present disclosure.

A kit or method of the present disclosure finds use in a wide variety of areas, including, e.g., infectious disease identification, and the like.

Methods for Characterizing a Target DNA

The present disclosure provides methods for characterizing a target DNA that is present in a sample. The methods involve contacting the sample with a type V CRISPR/Cas effector protein and one or more guide RNAs, where the contacting step generates a protospacer-adjacent motif (PAM)-distal cleavage product comprising a 5' overhang; and ligating a double-stranded nucleic acid adapter to the cleavage product, to generate a ligation product. The double-stranded nucleic acid adapter comprises a 5' overhang that comprises a stretch of from 3 to 15 contiguous nucleotides that are complementary to a contiguous stretch of nucleotides of the same length in the 5' overhang of the PAM-distal cleavage product. The ligation product includes the target DNA, which can be sequenced. The sample can be subjected to one or more amplification steps prior to the contacting step, with primers that provide for amplification of nucleic acids of, e.g., specific pathogens, categories of pathogens, two or more different pathogens, or two or more different categories of pathogens. The sample can also be subjected to one or more nucleic acid modification steps before contacting the sample with a type V CRISPR/Cas effector protein and/or prior to ligation. The sample can also be contacted with a ssDNA reporter molecule (a labelled single-stranded detector DNA), a guide RNA, and a type V CRISPR/Cas effector protein, such that, upon contact with a target DNA present in the sample, a signal is produced. For example, in some cases, a method of the present disclosure comprises: a) contacting a sample comprising (or suspected of comprising) a target nucleic acid with: i) a type V CRISPR/Cas effector polypeptide; ii) a guide RNA; and iii) a labelled single-stranded detector DNA, where the labelled single-stranded detector DNA produces a signal when the target nucleic acid is present in the sample, and where the contacting step generates a PAM-distal cleavage product comprising a 5' overhang; and b) and ligating a double-stranded nucleic acid adapter to the cleavage product, to generate a ligation product. In some cases, a method of the present disclosure comprises: a) contacting a sample comprising (or suspected of comprising) a target nucleic acid with one or more amplification primers or primer pairs, thereby generating an amplification product(s); b) contacting the sample comprising the amplification product(s) with: i) a type V CRISPR/Cas effector polypeptide; ii) a guide RNA; and iii) a labelled single-stranded detector DNA, where the labelled single-stranded detector DNA produces a signal when the target nucleic acid is present in the sample, and where the contacting step generates a PAM-distal cleavage product comprising a 5' overhang; and c) and ligating a double-stranded nucleic acid adapter to the cleavage product, to generate a ligation product. In some cases, a method of the present disclosure comprises: a) contacting a sample comprising (or suspected of comprising) a target ribonucleic acid with a reverse transcriptase, thereby generating a target DNA; b) contacting the sample comprising the comprising the target DNA with: i) a type V CRISPR/Cas effector polypeptide; ii) a guide RNA; and iii) a labelled single-stranded detector DNA, where the labelled single-stranded detector DNA produces a signal when the target nucleic acid is present in the sample, and where the contacting step generates a PAM-distal cleavage product comprising a 5' overhang; and c) and ligating a double-stranded nucleic acid adapter to the cleavage product, to generate a ligation product. In some cases, a method of the present disclosure comprises: a) contacting a sample comprising (or suspected of comprising) a target ribonucleic acid with a reverse transcriptase, thereby generating a target DNA; b) contacting the sample comprising the target DNA with one or more amplification primers or primer pairs, thereby generating an amplification product(s); c) contacting the sample comprising the amplification product(s) with: i) a type V CRISPR/Cas effector polypeptide; ii) a guide RNA; and iii) a labelled single-stranded detector DNA, where the labelled single-stranded detector DNA produces a signal when the target nucleic acid is present in the sample, and where the contacting step generates a PAM-distal cleavage product comprising a 5' overhang; and d) and ligating a double-stranded nucleic acid adapter to the cleavage product, to generate a ligation product.

As noted above, in some cases, the ligation product is sequenced; e.g., the target DNA present in the ligation product is sequenced. The contacting, ligating, and sequencing steps can be carried out in a single reaction container (also referred to herein as a "reaction vessel"). Thus, in a single reaction container, a target DNA can be both detected and sequenced. In some cases, the contacting and ligating steps are carried out in a first reaction container, and the sequencing step is carried out in a second reaction container.

Figure 3:
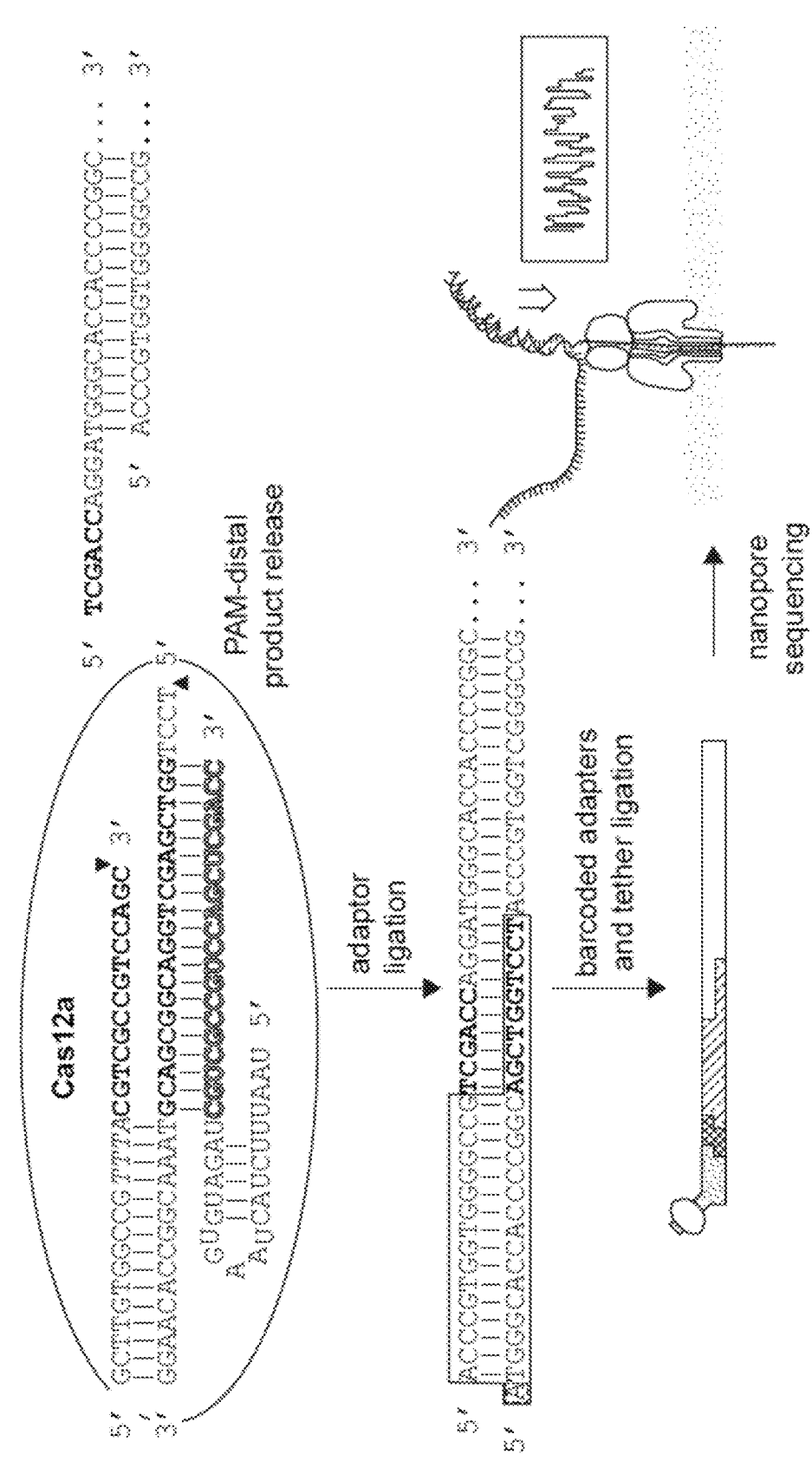
FIG. 3 is a schematic depiction of Cas12 cleavage and adapter ligation for nanopore sequencing. Following Cas12a cleavage (depicted are SEQ ID NO:22, 17381 and 17382) and DNA detection, the PAM-distal product containing a 5' overhang is released from the complex (SEQ ID NO:24 and 25), which is simultaneously ligated to a "dicker" molecule (also referred to herein as an "adapter") that can be directly coupled with next-generation sequencing protocols. The "clicker" contains a sequence complementary to the cleaved product for selective ligation and a 3' dA for adapter ligation (e.g., ligation to further adapters)(SEQ ID NO:27 and 28).
Figure 4:
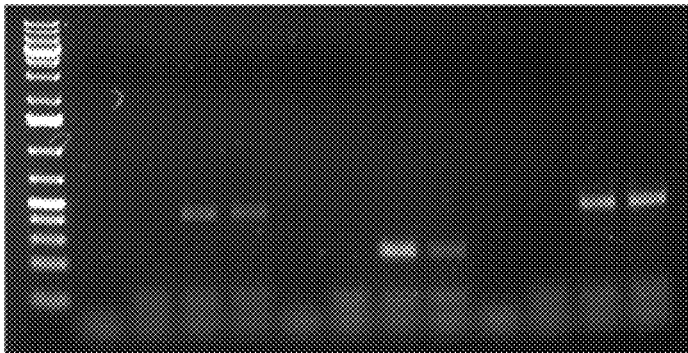
FIG. 4 depicts polymerase chain reaction (PCR) verification of clicker ligation using polymerase chain reaction (PCR). 16S rDNA sequences were amplified from genomic *E. coli* DNA and treated with the conditions indicated in the figure. The strand of the clicker molecule containing the 3' dA and complementary sequence was phosphorylated. Cas12-crRNA cleavage and clicker ligation were performed in a single step, in the presence of 1× binding buffer and 1×T4 ligase buffer at room temperature for 1 hour. Cleavage/ligation was verified by PCR amplification using a forward primer specific to the clicker and a reverse primer specific to the cleaved product.

Cleavage of a target DNA with a type V CRISPR/Cas effector polypeptide (e.g., a Cas12 polypeptide) generates a cleavage product having a 5' overhang of from about 4 nucleotides to about 12 nucleotides in length. This 5' overhang can provide a point of hybridization for an adapter molecule (e.g., a double-stranded nucleic acid adapter) having a 5' overhang with a nucleotide sequence that is at least partially complementary to the nucleotide sequence of the 5' overhang of the type V CRISPR/Cas effector polypeptide cleavage product. The adapter molecule can be ligated to the type V CRISPR/Cas effector polypeptide cleavage product, generating a type V CRISPR/Cas effector polypeptide cleavage product/adapter hybrid nucleic acid. The type V CRISPR/Cas effector polypeptide cleavage product/adapter hybrid nucleic acid can be ligated to one or more additional adapters, e.g., an adapter that provides a bar code, an adapter that allows for next-generation sequencing, and the like. For example, the one or more additional adapters can include a nucleotide sequence specific for coupling to a sequencing platform; such an adapter may also include a barcode sequence. In some cases, the additional adapter comprises a nucleotide sequence that is at least 70% identical to a support-bound oligonucleotide conjugated to a solid support; in some cases, the solid support is coupled to a sequencing platform. In some cases, the additional adapter comprises a binding site for a sequencing primer. Ligation of various adapters to a type V CRISPR/Cas effector polypeptide cleavage product is depicted schematically in FIG. 3.

The contacting step of a subject method can be carried out in a composition comprising divalent metal ions. The contacting step can be carried out in an acellular environment, e.g., outside of a cell. The contacting step can be carried out inside a cell. The contacting step can be carried out in a cell in vitro. The contacting step can be carried out in a cell ex vivo. The contacting step can be carried out in a cell in vivo.

As noted above, nucleic acid(s) present in a sample can be subjected to one or more nucleic acid modification steps before contacting the sample with a type V CRISPR/Cas effector protein and/or prior to ligation. For example, in some cases, a dsDNA can be subjected to dephosphorylation prior to cleavage with a type V CRISPR/Cas effector protein. The dephosphorylation step would avoid sequencing of dsDNA not cleaved by the type V CRISPR/Cas effector protein. As another example, in some cases, a dsDNA is cleaved with a type V CRISPR/Cas effector protein and, prior to ligation with a double-stranded nucleic acid adapter, the cleavage product is subjected to Klenow repair of overhangs, e.g., to fill in a 3' overhang.

The guide RNA can be provided as RNA or as a nucleic acid encoding the guide RNA (e.g., a DNA such as a recombinant expression vector). The Type V CRISPR/Cas effector protein (e.g., a Cas12 protein such as Cas12a, Cas12b, Cas12c, Cas12d, Cas12e) can be provided as a protein or as a nucleic acid encoding the protein (e.g., an mRNA, a DNA such as a recombinant expression vector). In some cases, two or more (e.g., 3 or more, 4 or more, 5 or more, or 6 or more) guide RNAs can be provided by (e.g., using a precursor guide RNA array, which can be cleaved by the Type V CRISPR/Cas effector protein into individual ("mature") guide RNAs).

In some cases (e.g., when contacting with a guide RNA and a Type V CRISPR/Cas effector protein (e.g., a Cas12 protein such as Cas12a, Cas12b, Cas12c, Cas12d, Cas12e)), the sample is contacted for 2 hours or less (e.g., 1.5 hours or less, 1 hour or less, 40 minutes or less, 30 minutes or less, 20 minutes or less, 10 minutes or less, or 5 minutes or less, or 1 minute or less) prior to the ligating step. For example, in some cases, the sample is contacted for 40 minutes or less prior to the ligating step. In some cases, the sample is contacted for 20 minutes or less prior to the ligating step. In some cases, the sample is contacted for 10 minutes or less prior to the ligating step. In some cases, the sample is contacted for 5 minutes or less prior to the ligating step. In some cases, the sample is contacted for 1 minute or less prior to the ligating step. In some cases, the sample is contacted for from 50 seconds to 60 seconds prior to the ligating step. In some cases, the sample is contacted for from 40 seconds to 50 seconds prior to the ligating step. In some cases, the sample is contacted for from 30 seconds to 40 seconds prior to the ligating step. In some cases, the sample is contacted for from 20 seconds to 30 seconds prior to the ligating step. In some cases, the sample is contacted for from 10 seconds to 20 seconds prior to the ligating step.

A method of the present disclosure for characterizing a target DNA (single-stranded or double-stranded) in a sample can provide for characterization of a target DNA with a high degree of sensitivity. In some cases, a method of the present disclosure can be used to characterize a target DNA present in a sample comprising a plurality of DNAs (including the target DNA and a plurality of non-target DNAs), where the target DNA is present at one or more copies per $10^7$ non-target DNAs (e.g., one or more copies per $10^6$ non-target DNAs, one or more copies per $10^5$ non-target DNAs, one or more copies per $10^4$ non-target DNAs, one or more copies per $10^3$ non-target DNAs, one or more copies per $10^2$ non-target DNAs, one or more copies per 50 non-target DNAs, one or more copies per 20 non-target DNAs, one or more copies per 10 non-target DNAs, or one or more copies per 5 non-target DNAs). In some cases, a method of the present disclosure can be used to characterize a target DNA present in a sample comprising a plurality of DNAs (including the target DNA and a plurality of non-target DNAs), where the target DNA is present at one or more copies per $10^{18}$ non-target DNAs (e.g., one or more copies per $10^{15}$ non-target DNAs, one or more copies per $10^{12}$ non-target DNAs, one or more copies per $10^9$ non-target DNAs, one or more copies per $10^6$ non-target DNAs, one or more copies per $10^5$ non-target DNAs, one or more copies per $10^4$ non-target DNAs, one or more copies per $10^3$ non-target DNAs, one or more copies per $10^2$ non-target DNAs, one or more copies per 50 non-target DNAs, one or more copies per 20 non-target DNAs, one or more copies per 10 non-target DNAs, or one or more copies per 5 non-target DNAs).

In some cases, a method of the present disclosure can characterize a target DNA present in a sample, where the target DNA is present at from one copy per $10^7$ non-target DNAs to one copy per 10 non-target DNAs (e.g., from 1 copy per $10^7$ non-target DNAs to 1 copy per $10^2$ non-target DNAs, from 1 copy per $10^7$ non-target DNAs to 1 copy per $10^3$ non-target DNAs, from 1 copy per $10^7$ non-target DNAs to 1 copy per $10^4$ non-target DNAs, from 1 copy per $10^7$ non-target DNAs to 1 copy per $10^5$ non-target DNAs, from 1 copy per $10^7$ non-target DNAs to 1 copy per $10^6$ non-target DNAs, from 1 copy per $10^6$ non-target DNAs to 1 copy per 10 non-target DNAs, from 1 copy per $10^6$ non-target DNAs to 1 copy per $10^2$ non-target DNAs, from 1 copy per $10^6$ non-target DNAs to 1 copy per $10^3$ non-target DNAs, from 1 copy per $10^6$ non-target DNAs to 1 copy per $10^4$ non-target DNAs, from 1 copy per $10^6$ non-target DNAs to 1 copy per $10^5$ non-target DNAs, from 1 copy per $10^5$ non-target DNAs to 1 copy per 10 non-target DNAs, from 1 copy per $10^5$ non-target DNAs to 1 copy per $10^2$ non-target DNAs, from 1 copy per $10^5$ non-target DNAs to 1 copy per $10^3$ non-target DNAs, or from 1 copy per $10^5$ non-target DNAs to 1 copy per $10^4$ non-target DNAs).

In some cases, a method of the present disclosure can characterize a target DNA present in a sample, where the target DNA is present at from one copy per $10^{18}$ non-target DNAs to one copy per 10 non-target DNAs (e.g., from 1 copy per $10^{18}$ non-target DNAs to 1 copy per $10^2$ non-target DNAs, from 1 copy per $10^{15}$ non-target DNAs to 1 copy per $10^2$ non-target DNAs, from 1 copy per $10^{12}$ non-target DNAs to 1 copy per $10^2$ non-target DNAs, from 1 copy per $10^9$ non-target DNAs to 1 copy per $10^2$ non-target DNAs, from 1 copy per $10^7$ non-target DNAs to 1 copy per $10^2$ non-target DNAs, from 1 copy per $10^7$ non-target DNAs to 1 copy per $10^3$ non-target DNAs, from 1 copy per $10^7$ non-target DNAs to 1 copy per $10^4$ non-target DNAs, from 1 copy per $10^7$ non-target DNAs to 1 copy per $10^5$ non-target DNAs, from 1 copy per $10^7$ non-target DNAs to 1 copy per $10^6$ non-target DNAs, from 1 copy per $10^6$ non-target DNAs to 1 copy per 10 non-target DNAs, from 1 copy per $10^6$ non-target DNAs to 1 copy per $10^2$ non-target DNAs, from 1 copy per $10^6$ non-target DNAs to 1 copy per $10^3$ non-target DNAs, from 1 copy per $10^6$ non-target DNAs to 1 copy per $10^4$ non-target DNAs, from 1 copy per $10^6$ non-target DNAs to 1 copy per $10^5$ non-target DNAs, from 1 copy per $10^5$ non-target DNAs to 1 copy per 10 non-target DNAs, from 1 copy per $10^5$ non-target DNAs to 1 copy per $10^2$ non-target DNAs, from 1 copy per $10^5$ non-target DNAs to 1 copy per $10^3$ non-target DNAs, or from 1 copy per $10^5$ non-target DNAs to 1 copy per $10^4$ non-target DNAs).

In some cases, a method of the present disclosure can characterize a target DNA present in a sample, where the target DNA is present at from one copy per $10^7$ non-target DNAs to one copy per 100 non-target DNAs (e.g., from 1 copy per $10^7$ non-target DNAs to 1 copy per $10^2$ non-target DNAs, from 1 copy per $10^7$ non-target DNAs to 1 copy per $10^3$ non-target DNAs, from 1 copy per $10^7$ non-target DNAs to 1 copy per $10^4$ non-target DNAs, from 1 copy per $10^7$ non-target DNAs to 1 copy per $10^5$ non-target DNAs, from 1 copy per $10^7$ non-target DNAs to 1 copy per $10^6$ non-target DNAs, from 1 copy per $10^6$ non-target DNAs to 1 copy per 100 non-target DNAs, from 1 copy per $10^6$ non-target DNAs to 1 copy per $10^2$ non-target DNAs, from 1 copy per $10^6$ non-target DNAs to 1 copy per $10^3$ non-target DNAs, from 1 copy per $10^6$ non-target DNAs to 1 copy per $10^4$ non-target DNAs, from 1 copy per $10^6$ non-target DNAs to 1 copy per $10^5$ non-target DNAs, from 1 copy per $10^5$ non-target DNAs to 1 copy per 100 non-target DNAs, from 1 copy per $10^5$ non-target DNAs to 1 copy per $10^2$ non-target DNAs, from 1 copy per $10^5$ non-target DNAs to 1 copy per $10^3$ non-target DNAs, or from 1 copy per $10^5$ non-target DNAs to 1 copy per $10^4$ non-target DNAs).

In some cases, the target DNA is present in the sample at a concentration of 10 nM or less, e.g., from about 1 attomolar (aM) to about 100 aM, from about 100 aM to about 500 aM, from about 500 aM to about 1 femtomolar (fM), from about 1 fM to about 100 fM, from about 100 fM to about 500 fM, from about 500 fM to about 1 picomolar (pM), from about 1 pM to about 100 pM, from about 100 pM to about 500 pM, from about 500 pM to about 1 nanomolar (nM), from about 1 nM to about 100 nM, from about 100 nM to about 500 nM, or from about 500 nM to about 1 μM, or more than 1 μM.

In some cases, the target DNA is present in the sample at a concentration of from 500 fM to 1 nM (e.g., from 500 fM to 500 pM, from 500 fM to 200 pM, from 500 fM to 100 pM, from 500 fM to 10 pM, from 500 fM to 1 pM, from 800 fM to 1 nM, from 800 fM to 500 pM, from 800 fM to 200 pM, from 800 fM to 100 pM, from 800 fM to 10 pM, from 800 fM to 1 pM, from 1 pM to 1 nM, from 1 pM to 500 pM, from 1 pM to 200 pM, from 1 pM to 100 pM, or from 1 pM to 10 pM). In some cases, Type V CRISPR/Cas Effector Proteins As noted above, a method of the present disclosure includes use of a Type V CRISPR/Cas effector polypeptide, where a sample that comprises, or is suspected of comprising, a target DNA is contacted with a Type V CRISPR/Cas effector polypeptide and one or more guide RNAs. Type V CRISPR/Cas effector proteins are a subtype of Class 2 CRISPR/Cas effector proteins. For examples of type V CRISPR/Cas systems and their effector proteins (e.g., Cas12 family proteins such as Cas12a), see, e.g., Shmakov et al., Nat Rev Microbiol. 2017 March; 15(3):169-182: "Diversity and evolution of class 2 CRISPR-Cas systems." Examples include, but are not limited to: Cas12 family (Cas12a, Cas12b, Cas12c), C2c4, C2c8, C2c5, C2c10, and C2c9; as well as CasX (Cas12e) and CasY (Cas12d). Also see, e.g., Koonin et al., Curr Opin Microbiol. 2017 June; 37:67-78: "Diversity, classification and evolution of CRISPR-Cas systems."

In some cases, a type V CRISPR/Cas effector protein suitable for use in a method of the present disclosure is a Cas12 protein (e.g., Cas12a, Cas12b, Cas12c). In some cases, a suitable type V CRISPR/Cas effector protein is a Cas12 protein such as Cas12a, Cas12b, Cas12c, Cas12d, Cas12e, Cas12d, or Cas12e. In some cases, a suitable type V CRISPR/Cas effector protein is a Cas12a protein. In some cases, a suitable type V CRISPR/Cas effector protein is a Cas12b protein. In some cases, a suitable type V CRISPR/Cas effector protein is a Cas12c protein. In some cases, a suitable type V CRISPR/Cas effector protein is a Cas12d protein. In some cases, a suitable type V CRISPR/Cas effector protein is a Cas12e protein. In some cases, a suitable type V CRISPR/Cas effector protein is protein selected from: Cas12 (e.g., Cas12a, Cas12b, Cas12c, Cas12d, Cas12e), C2c4, C2c8, C2c5, C2c00, and C2c9. In some cases, a suitable type V CRISPR/Cas effector protein is protein selected from: C2c4, C2c8, C2c5, C2c00, and C2c9. In some cases, a suitable type V CRISPR/Cas effector protein is protein selected from: C2c4, C2c8, and C2c5. In some cases, a suitable type V CRISPR/Cas effector protein is protein selected from: C2c10 and C2c9.

In some cases, a suitable type V CRISPR/Cas effector protein is a naturally-occurring protein (e.g., naturally occurs in prokaryotic cells). In other cases, the Type V CRISPR/Cas effector protein is not a naturally-occurring polypeptide (e.g., the effector protein is a variant protein, a chimeric protein, includes a fusion partner, and the like). Examples of naturally occurring Type V CRISPR/Cas effector proteins include, but are not limited to, those depicted in FIG. 6 (e.g., FIG. 6A-6T). Any Type V CRISPR/Cas effector protein can be suitable for the compositions (e.g., nucleic acids, kits, etc.) and methods of the present disclosure (e.g., as long as the Type V CRISPR/Cas effector protein forms a complex with a guide RNA and exhibits ssDNA cleavage activity of non-target ssDNAs once it is activated (by hybridization of and associated guide RNA to its target DNA).

In some cases, a type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a Cas12 protein (e.g., Cas12a, Cas12b, Cas12c) (e.g., a Cas12 protein depicted in any one of FIG. 6A-6T). For example, In some cases, a type V CRISPR/Cas effector protein comprises an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a Cas12 protein (e.g., Cas12a, Cas12b, Cas12c) (e.g., a Cas12 protein depicted in FIG. 6). In some cases, a type V CRISPR/Cas effector protein comprises an amino acid sequence having 80% or more sequence identity (e.g., 85% or more, 90% or more, 95% or more, 97% or more, 98% or more, 99% or more, or 100% sequence identity) with a Cas12 protein (e.g., Cas12a, Cas12b, Cas12c) (e.g., a Cas12 protein depicted in any one of FIG. 6A-6T). In some cases, a type V CRISPR/Cas effector protein comprises an amino acid sequence having 90% or more sequence identity (e.g., 95% or more, 97% or more, 98% or more, 99% or more, or 100% sequence identity) with a Cas12 protein (e.g., Cas12a, Cas12b, Cas12c) (e.g., a Cas12 protein depicted in FIG. 6). In some cases, a type V CRISPR/Cas effector protein comprises a Cas12 amino acid sequence (e.g., Cas12a, Cas12b, Cas12c) depicted in any one of FIG. 6A-6T.

In some cases, a type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a Cas12a protein (e.g., a Cas12a protein depicted in any FIG. 6). For example, in some cases, a type V CRISPR/Cas effector protein comprises an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a Cas12a protein (e.g., a Cas12a protein depicted in FIG. 6). In some cases, a type V CRISPR/Cas effector protein comprises an amino acid sequence having 80% or more sequence identity (e.g., 85% or more, 90% or more, 95% or more, 97% or more, 98% or more, 99% or more, or 100% sequence identity) with a Cas12a protein (e.g., a Cas12a protein depicted in FIG. 6). In some cases, a type V CRISPR/Cas effector protein comprises an amino acid sequence having 90% or more sequence identity (e.g., 95% or more, 97% or more, 98% or more, 99% or more, or 100% sequence identity) with a Cas12a protein (e.g., a Cas12a protein depicted in FIG. 6). In some cases, a type V CRISPR/Cas effector protein comprises a Cas12a amino acid sequence depicted in FIG. 6.

In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Lachnospiraceae bacterium ND2006 Cas12a protein amino acid sequence depicted in FIG. 6. In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the *Acidaminococcus* spBV3L6 Cas12a protein amino acid sequence depicted in FIG. 6. In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the *Francisella novicida* U112 Cas12a protein amino acid sequence depicted in FIG. 6. In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the *Porphyromonas macacae* Cas12a protein amino acid sequence depicted in FIG. 6. In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the *Moraxella bovoculi* 237 Cas12a protein amino acid sequence depicted in FIG. 6. In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the *Moraxella bovoculi* AAX08_00205 Cas12a protein amino acid sequence depicted in FIG. 6. In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the *Moraxella bovoculi* AAX11_00205 Cas12a protein amino acid sequence depicted in FIG. 6. In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the *Thiomicrospira* sp. XSS Cas12a protein amino acid sequence depicted in FIG. 6. In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the *Butyrivibrio* sp. NC3005 Cas12a protein amino acid sequence depicted in FIG. 6. In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the AACCas12b amino acid sequence depicted in FIG. 6.

In some cases, a type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a Cas12b protein (e.g., a Cas12b protein depicted in FIG. 6). For example, in some cases, a type V CRISPR/Cas effector protein comprises an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a Cas12b protein (e.g., a Cas12b protein depicted in FIG. 6). In some cases, a type V CRISPR/Cas effector protein comprises an amino acid sequence having 80% or more sequence identity (e.g., 85% or more, 90% or more, 95% or more, 97% or more, 98% or more, 99% or more, or 100% sequence identity) with a Cas12b protein (e.g., a Cas12b protein depicted in FIG. 6). In some cases, a type V CRISPR/Cas effector protein comprises an amino acid sequence having 90% or more sequence identity (e.g., 95% or more, 97% or more, 98% or more, 99% or more, or 100% sequence identity) with a Cas12b protein (e.g., a Cas12b protein depicted in FIG. 6). In some cases, a type V CRISPR/Cas effector protein comprises a Cas12b amino acid sequence depicted in FIG. 6.

In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12b amino acid sequence depicted in FIG. 6A.

In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12b amino acid sequence depicted in FIG. 6B.

In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12b amino acid sequence depicted in FIG. 6C.

In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12b amino acid sequence depicted in FIG. 6D.

In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12b amino acid sequence depicted in FIG. 6E.

In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12b amino acid sequence depicted in FIG. 6F.

In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12b amino acid sequence depicted in FIG. 6G.

In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12b amino acid sequence depicted in FIG. 6H.

In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12b amino acid sequence depicted in FIG. 6I.

In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12b amino acid sequence depicted in FIG. 6J.

In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12e amino acid sequence depicted in FIG. 7A.

In some cases, a suitable type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12e amino acid sequence depicted in FIG. 7B.

In some cases, a type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a Cas12, C2c4, C2c8, C2c5, C2c10, or C2c9 protein. For example, in some cases, a type V CRISPR/Cas effector protein comprises an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a Cas12, C2c4, C2c8, C2c5, C2c10, or C2c9 protein. In some cases, a type V CRISPR/Cas effector protein comprises an amino acid sequence having 80% or more sequence identity (e.g., 85% or more, 90% or more, 95% or more, 97% or more, 98% or more, 99% or more, or 100% sequence identity) with a Cas12, C2c4, C2c8, C2c5, C2c10, or C2c9 protein. In some cases, a type V CRISPR/Cas effector protein comprises an amino acid sequence having 90% or more sequence identity (e.g., 95% or more, 97% or more, 98% or more, 99% or more, or 100% sequence identity) with a Cas12, C2c4, C2c8, C2c5, C2c10, or C2c9 protein. In some cases, a type V CRISPR/Cas effector protein comprises a Cas12, C2c4, C2c8, C2c5, C2c10, or C2c9 amino acid sequence.

In some cases, a type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a Cas12, C2c4, C2c8, or C2c5 protein. For example, In some cases, a type V CRISPR/Cas effector protein comprises an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a Cas12, C2c4, C2c8, or C2c5 protein. In some cases, a type V CRISPR/Cas effector protein comprises an amino acid sequence having 80% or more sequence identity (e.g., 85% or more, 90% or more, 95% or more, 97% or more, 98% or more, 99% or more, or 100% sequence identity) with a Cas12, C2c4, C2c8, or C2c5 protein. In some cases, a type V CRISPR/Cas effector protein comprises an amino acid sequence having 90% or more sequence identity (e.g., 95% or more, 97% or more, 98% or more, 99% or more, or 100% sequence identity) with a Cas12, C2c4, C2c8, or C2c5 protein. In some cases, a type V CRISPR/Cas effector protein comprises a Cas12, C2c4, C2c8, or C2c5 amino acid sequence.

In some cases, a type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a C2c4, C2c8, or C2c5 protein. For example, in some cases, a type V CRISPR/Cas effector protein comprises an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a C2c4, C2c8, or C2c5 protein. In some cases, a type V CRISPR/Cas effector protein comprises an amino acid sequence having 80% or more sequence identity (e.g., 85% or more, 90% or more, 95% or more, 97% or more, 98% or more, 99% or more, or 100% sequence identity) with a C2c4, C2c8, or C2c5 protein. In some cases, a type V CRISPR/Cas effector protein comprises an amino acid sequence having 90% or more sequence identity (e.g., 95% or more, 97% or more, 98% or more, 99% or more, or 100% sequence identity) with a C2c4, C2c8, or C2c5 protein. In some cases, a type V CRISPR/Cas effector protein comprises a C2c4, C2c8, or C2c5 amino acid sequence.

In some cases, a type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a Cas12, C2c10, or C2c9 protein. For example, In some cases, a type V CRISPR/Cas effector protein comprises an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a Cas12, C2c10, or C2c9 protein. In some cases, a type V CRISPR/Cas effector protein comprises an amino acid sequence having 80% or more sequence identity (e.g., 85% or more, 90% or more, 95% or more, 97% or more, 98% or more, 99% or more, or 100% sequence identity) with a Cas12, C2c10, or C2c9 protein. In some cases, a type V CRISPR/Cas effector protein comprises an amino acid sequence having 90% or more sequence identity (e.g., 95% or more, 97% or more, 98% or more, 99% or more, or 100% sequence identity) with a Cas12, C2c10, or C2c9 protein. In some cases, a type V CRISPR/Cas effector protein comprises a Cas12, C2c10, or C2c9 amino acid sequence.

In some cases, a type V CRISPR/Cas effector protein comprises an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a C2c10 or C2c9 protein. For example, In some cases, a type V CRISPR/Cas effector protein comprises an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a C2c10 or C2c9 protein. In some cases, a type V CRISPR/Cas effector protein comprises an amino acid sequence having 80% or more sequence identity (e.g., 85% or more, 90% or more, 95% or more, 97% or more, 98% or more, 99% or more, or 100% sequence identity) with a C2c10 or C2c9 protein. In some cases, a type V CRISPR/Cas effector protein comprises an amino acid sequence having 90% or more sequence identity (e.g., 95% or more, 97% or more, 98% or more, 99% or more, or 100% sequence identity) with a C2c10 or C2c9 protein. In some cases, a type V CRISPR/Cas effector protein comprises a C2c10 or C2c9 amino acid sequence.

In some cases, a subject type V CRISPR/Cas effector protein (e.g., a Cas12 protein such as Cas12a, Cas12b, Cas12c, Cas12d, Cas12e) is fused to (conjugated to) a heterologous polypeptide. In some cases, a heterologous polypeptide (a fusion partner) provides for subcellular localization, i.e., the heterologous polypeptide contains a subcellular localization sequence (e.g., a nuclear localization signal (NLS) for targeting to the nucleus, a sequence to keep the fusion protein out of the nucleus, e.g., a nuclear export sequence (NES), a sequence to keep the fusion protein retained in the cytoplasm, a mitochondrial localization signal for targeting to the mitochondria, a chloroplast localization signal for targeting to a chloroplast, an endoplasmic reticulum (ER) retention signal, and the like). In some cases, a type V CRISPR/Cas effector protein (e.g., a Cas12 protein) does not include a NLS so that the protein is not targeted to the nucleus (which can be advantageous, e.g., when it desirable to cleave non-target ssDNAs in the cytosol). In some cases, the heterologous polypeptide can provide a tag (i.e., the heterologous polypeptide is a detectable label) for ease of tracking and/or purification (e.g., a fluorescent protein, e.g., a green fluorescent protein (GFP), a yellow fluorescent protein (YFP), a red fluorescent protein (RFP), a cyan fluorescent protein (CFP), mCherry, tdTomato, and the like; a histidine tag, e.g., a 6×His tag; a hemagglutinin (HA) tag; a FLAG tag; a Myc tag; and the like).

In some cases, a type V CRISPR/Cas effector protein (e.g., a Cas12 protein such as Cas12a, Cas12b, Cas12c, Cas12d, Cas12e) includes (is fused to) a nuclear localization signal (NLS) (e.g., in some cases 2 or more, 3 or more, 4 or more, or 5 or more NLSs). Thus, in some cases, a type V CRISPR/Cas effector protein includes one or more NLSs (e.g., 2 or more, 3 or more, 4 or more, or 5 or more NLSs). In some cases, one or more NLSs (2 or more, 3 or more, 4 or more, or 5 or more NLSs) are positioned at or near (e.g., within 50 amino acids of) the N-terminus and/or the C-terminus. In some cases, one or more NLSs (2 or more, 3 or more, 4 or more, or 5 or more NLSs) are positioned at or near (e.g., within 50 amino acids of) the N-terminus. In some cases, one or more NLSs (2 or more, 3 or more, 4 or more, or 5 or more NLSs) are positioned at or near (e.g., within 50 amino acids of) the C-terminus. In some cases, one or more NLSs (3 or more, 4 or more, or 5 or more NLSs) are positioned at or near (e.g., within 50 amino acids of) both the N-terminus and the C-terminus. In some cases, an NLS is positioned at the N-terminus and an NLS is positioned at the C-terminus.

In some cases, a type V CRISPR/Cas effector protein (e.g., a Cas12 protein such as Cas12a, Cas12b, Cas12c, Cas12d, Cas12e) includes (is fused to) between 1 and 10 NLSs (e.g., 1-9, 1-8, 1-7, 1-6, 1-5, 2-10, 2-9, 2-8, 2-7, 2-6, or 2-5 NLSs). In some cases, a type V CRISPR/Cas effector protein includes (is fused to) between 2 and 5 NLSs (e.g., 2-4, or 2-3 NLSs).

Non-limiting examples of NLSs include an NLS sequence derived from: the NLS of the SV40 virus large T-antigen, having the amino acid sequence PKKKRKV (SEQ ID NO:1); the NLS from nucleoplasmin (e.g., the nucleoplasmin bipartite NLS with the sequence KRPAATKK-AGQAKKKK (SEQ ID NO:2)); the c-myc NLS having the amino acid sequence PAAKRVKLD (SEQ ID NO:3) or RQRRNELKRSP (SEQ ID NO:4); the hRNPA1 M9 NLS having the sequence NQSSNFGPMKGGNFGGRSSGP-YGGGGQYFAKPRNQGGY (SEQ ID NO:5); the sequence RMRIZFKNKGKDTAELRRRRVEVSVELRKAKKDEQ-ILKRRNV (SEQ ID NO:6) of the IBB domain from importin-alpha; the sequences VSRKRPRP (SEQ ID NO:7) and PPKKARED (SEQ ID NO:8) of the myoma T protein; the sequence PQPKKKPL (SEQ ID NO:9) of human p53; the sequence SALIKKKKKMAP (SEQ ID NO:10) of mouse c-abl IV; the sequences DRLRR (SEQ ID NO:11) and PKQKKRK (SEQ ID NO:12) of the influenza virus NS1; the sequence RKLKKKIKKL (SEQ ID NO:13) of the Hepatitis virus delta antigen; the sequence REKKKFLKRR (SEQ ID NO:14) of the mouse Mx1 protein; the sequence KRKGDEVDGVDEVAKKKSKK (SEQ ID NO:15) of the human poly(ADP-ribose) polymerase; and the sequence RKCLQAGMNLEARKTKK (SEQ ID NO:16) of the steroid hormone receptors (human) glucocorticoid. In general, NLS (or multiple NLSs) are of sufficient strength to drive accumulation of the protein in a detectable amount in the nucleus of a eukaryotic cell. Detection of accumulation in the nucleus may be performed by any suitable technique.

Protospacer Adjacent Motif (PAM)

A Type V CRISPR/Cas effector protein binds to target DNA at a target sequence defined by the region of complementarity between the DNA-targeting RNA and the target DNA. As is the case for many CRISPR/Cas endonucleases, site-specific binding (and/or cleavage) of a double stranded target DNA occurs at locations determined by both (i) base-pairing complementarity between the guide RNA and the target DNA; and (ii) a short motif (referred to as the protospacer adjacent motif (PAM)) in the target DNA.

In some cases, the PAM for a Type V CRISPR/Cas effector protein is immediately 5' of the target sequence (e.g., of the non-complementary strand of the target DNA— the complementary strand hybridizes to the guide sequence of the guide RNA while the non-complementary strand does not directly hybridize with the guide RNA and is the reverse complement of the non-complementary strand). In some cases (e.g., when Cas12a or Cas12b as described herein is used), the PAM sequence is 5'-TTN-3'. In some cases, the PAM sequence is 5'-TTTN-3'. (e.g., see FIG. 6V).

In some cases, different Type V CRISPR/Cas effector proteins (i.e., Type V CRISPR/Cas effector proteins from various species) may be advantageous to use in the various provided methods in order to capitalize on a desired feature (e.g., specific enzymatic characteristics of different Type V CRISPR/Cas effector proteins). Type V CRISPR/Cas effector proteins from different species may require different PAM sequences in the target DNA. Thus, for a particular Type V CRISPR/Cas effector protein of choice, the PAM sequence requirement may be different than the 5'-TTN-3' or 5'-TTTN-3' sequence described above. Various methods (including in silico and/or wet lab methods) for identification of the appropriate PAM sequence are known in the art and are routine, and any convenient method can be used.

Guide RNA

A nucleic acid molecule (e.g., a natural crRNA) that binds to a type V CRISPR/Cas effector protein (e.g., a Cas12 protein such as Cas12a, Cas12b, Cas12c, Cas12d, Cas12e), forming a ribonucleoprotein complex (RNP), and targets the complex to a specific target sequence within a target DNA is referred to herein as a "guide RNA." It is to be understood that in some cases, a hybrid DNA/RNA can be made such that a guide RNA includes DNA bases in addition to RNA bases—but the term "guide RNA" is still used herein to encompass such hybrid molecules. A subject guide RNA includes a guide sequence (also referred to as a "spacer") (that hybridizes to target sequence of a target DNA) and a constant region (e.g., a region that is adjacent to the guide sequence and binds to the type V CRISPR/Cas effector protein). A "constant region" can also be referred to herein as a "protein-binding segment." In some cases, e.g., for Cas12a, the constant region is 5' of the guide sequence.

Guide Sequence

The guide sequence has complementarity with (hybridizes to) a target sequence of the target DNA. In some cases, the guide sequence is 15-28 nucleotides (nt) in length (e.g., 15-26, 15-24, 15-22, 15-20, 15-18, 16-28, 16-26, 16-24, 16-22, 16-20, 16-18, 17-26, 17-24, 17-22, 17-20, 17-18, 18-26, 18-24, or 18-22 nt in length). In some cases, the guide sequence is 18-24 nucleotides (nt) in length. In some cases, the guide sequence is at least 15 nt long (e.g., at least 16, 18, 20, or 22 nt long). In some cases, the guide sequence is at least 17 nt long. In some cases, the guide sequence is at least 18 nt long. In some cases, the guide sequence is at least 20 nt long.

In some cases, the guide sequence has 80% or more (e.g., 85% or more, 90% or more, 95% or more, or 100% complementarity) with the target sequence of the target DNA. In some cases, the guide sequence is 100%6 complementary to the target sequence of the target DNA. In some cases, the target DNA includes at least 15 nucleotides (nt) of complementarity with the guide sequence of the guide RNA.

Guide sequences suitable for use in connection with detection of viral pathogens can be designed based on the nucleotide sequence of a viral pathogen. Guide sequences suitable for use in connection with detection of bacterial pathogens can be designed based on the nucleotide sequence of a bacterial pathogen. Guide sequences suitable for use in connection with detection of fungal pathogens can be designed based on the nucleotide sequence of a fungal pathogen. Guide sequences suitable for use in connection with detection of protozoan pathogens can be designed based on the nucleotide sequence of a protozoan pathogen. Guide sequences suitable for use in connection with detection of antibiotic resistance genes can be designed based on the nucleotide sequence of an antibiotic resistance gene.

Constant Region

Examples of constant regions for guide RNAs that can be used with a type V CRISPR/Cas effector protein (e.g., a Cas12 protein such as Cas12a, Cas12b, Cas12c, Cas12d, Cas12e) are presented in FIG. 6.

In some cases, a subject guide RNA includes a nucleotide sequence having 70% or more identity (e.g., 80% or more, 85% or more, 90% or more, 95% or more, 98% or more, 99% or more, or 100% identity) with any one of the crRNA repeat sequences set forth in FIG. 6. In some cases, a subject guide RNA includes a nucleotide sequence having 90% or more identity (e.g., 95% or more, 98% or more, 99% or more, or 100% identity) with any one of the crRNA repeat sequences set forth in FIG. 6. In some cases, a subject guide RNA includes a crRNA nucleotide sequence set forth in FIG. 6.

In some cases, the guide RNA includes a double stranded RNA duplex (dsRNA duplex). In some cases, a guide RNA includes a dsRNA duplex with a length of from 2 to 12 bp (e.g., from 2 to 10 bp, 2 to 8 bp, 2 to 6 bp, 2 to 5 bp, 2 to 4 bp, 3 to 12 bp, 3 to 10 bp, 3 to 8 bp, 3 to 6 bp, 3 to 5 bp, 3 to 4 bp, 4 to 12 bp, 4 to 10 bp, 4 to 8 bp, 4 to 6 bp, or 4 to 5 bp). In some cases, a guide RNA includes a dsRNA duplex that is 2 or more bp in length (e.g., 3 or more, 4 or more, 5 or more, 6 or more, or 7 or more bp in length). In some cases, a guide RNA includes a dsRNA duplex that is longer than the dsRNA duplex of a corresponding wild type guide RNA. In some cases, a guide RNA includes a dsRNA duplex that is shorter than the dsRNA duplex of a corresponding wild type guide RNA.

In some cases, the constant region of a guide RNA is 15 or more nucleotides (nt) in length (e.g., 18 or more, 20 or more, 21 or more, 22 or more, 23 or more, 24 or more, 25 or more, 26 or more, 27 or more, 28 or more, 29 or more, 30 or more, 31 or more nt, 32 or more, 33 or more, 34 or more, or 35 or more nt in length). In some cases, the constant region of a guide RNA is 18 or more nt in length.

In some cases, the constant region of a guide RNA has a length in a range of from 12 to 100 nt (e.g., from 12 to 90, 12 to 80, 12 to 70, 12 to 60, 12 to 50, 12 to 40, 15 to 100, 15 to 90, 15 to 80, 15 to 70, 15 to 60, 15 to 50, 15 to 40, 20 to 100, 20 to 90, 20 to 80, 20 to 70, 20 to 60, 20 to 50, 20 to 40, 25 to 100, 25 to 90, 25 to 80, 25 to 70, 25 to 60, 25 to 50, 25 to 40, 28 to 100, 28 to 90, 28 to 80, 28 to 70, 28 to 60, 28 to 50, 28 to 40, 29 to 100, 29 to 90, 29 to 80, 29 to 70, 29 to 60, 29 to 50, or 29 to 40 nt). In some cases, the constant region of a guide RNA has a length in a range of from 28 to 100 nt. In some cases, the region of a guide RNA that is 5' of the guide sequence has a length in a range of from 28 to 40 nt.

In some cases, the constant region of a guide RNA is truncated relative to (shorter than) the corresponding region of a corresponding wild type guide RNA. In some cases, the constant region of a guide RNA is extended relative to (longer than) the corresponding region of a corresponding wild type guide RNA. In some cases, a subject guide RNA is 30 or more nucleotides (nt) in length (e.g., 34 or more, 40 or more, 45 or more, 50 or more, 55 or more, 60 or more, 65 or more, 70 or more, or 80 or more nt in length). In some cases, the guide RNA is 35 or more nt in length.

Adapter Nucleic Acids

As noted above, a method of the present disclosure involves contacting the sample with a type V CRISPR/Cas effector protein and one or more guide RNAs, where the contacting step generates a PAM-distal cleavage product comprising a 5' overhang; and ligating a double-stranded nucleic acid adapter to the cleavage product, to generate a ligation product. The double-stranded nucleic acid adapter comprises a 5' overhang that comprises a stretch of from 3 to 15 contiguous nucleotides that are complementary to a contiguous stretch of nucleotides of the same length in the 5' overhang of the PAM-distal cleavage product. The ligation product includes the target DNA, which can be sequenced.

An adapter nucleic acid includes any nucleic acid having a sequence, at least a portion of which is known, that can be joined to a target polynucleotide. Adapter nucleic acids can comprise DNA, RNA, nucleotide analogues, non-canonical nucleotides, labeled nucleotides, modified nucleotides, or combinations thereof. Adapter nucleic acids can be single-stranded, double-stranded, or partial duplex. In general, a partial-duplex adapter comprises one or more single-stranded regions and one or more double-stranded regions. A partial-duplex adapter can be described as a "double-stranded nucleic acid adapter comprising a 5' overhang" (i.e., a 5' single-stranded overhang).

An adapter nucleic acid for use in a method of the present disclosure is double stranded, and comprises a 5' overhang that comprises a stretch of from 3 to 15 contiguous nucleotides that are complementary to a contiguous stretch of nucleotides of the same length in the 5' overhang of the PAM-distal cleavage product. In some cases, the 5' overhang has a length of from 3 nucleotides to 20 nucleotides; for example, the 5' overhang of the adapter nucleic acid can have a length of 3 nucleotides (nt), 4 nt, 5 nt, 6 nt, 7 nt, 8 nt, 9 nt, 10 nt, 11 nt, 12 nt, 13 nt, 14 nt, 15 nt, 16 nt, 17 nt, 18 nt, 19 nt, or 20 nt. In some cases, the 5' overhang has a length of from 8 nucleotides to 10 nucleotides. In some cases, the 5' overhang has a length of 8 nucleotides. In some cases, the 5' overhang has a length of 9 nucleotides. In some cases, the 5' overhang has a length of 10 nucleotides. The 5' overhang of the adapter nucleic acid can comprise a stretch of 3, 4, 5, 6, 7, 8, 9, 10, 11, 12, 13, 14, or 15 contiguous nucleotides that are complementary to a contiguous stretch of nucleotides of the same length in the 5' overhang of the PAM-distal cleavage product. In some cases, the 5' overhang of the adapter nucleic acid comprises a stretch of from 5 contiguous nucleotides to 10 contiguous nucleotides that are complementary to a contiguous stretch of nucleotides of the same length in the 5' overhang of the PAM-distal cleavage product. In some cases, the 5' overhang of the adapter nucleic acid comprises a stretch of from 8 contiguous nucleotides to 10 contiguous nucleotides that are complementary to a contiguous stretch of nucleotides of the same length in the 5' overhang of the PAM-distal cleavage product. In some cases, the 5' overhang of the adapter nucleic acid has a length of from 8 nucleotides to 10 nucleotides; and comprises a stretch of from 8 contiguous nucleotides to 10 contiguous nucleotides that are complementary to a contiguous stretch of nucleotides of the same length in the 5' overhang of the PAM-distal cleavage product.

The total length of the adapter nucleic acid (including the 5' overhang) can be from about 10 nucleotides to 100 nucleotides. For example, the total length of the adapter nucleic acid (including the 5' overhang) can be from about 10 nucleotides (nt) to 15 nt, from 15 nt to 20 nt, from 20 nt to 25 nt, from 25 nt to 30 nt, from 30 nt to 40 nt, from 40 nt to 50 nt, from 50 nt to 60 nt, from 60 nt to 70 nt, from 70 nt to 80 nt, from 80 nt to 90 nt, or from 90 nt to 100 nt. In some cases, the total length of the adapter nucleic acid (including the 5' overhang) is from about 10 nt to about 25 nt. In some cases, the total length of the adapter nucleic acid (including the 5' overhang) is from about 15 nt to about 20 nt. In some cases, the total length of the adapter nucleic acid (including the 5' overhang) is from about 15 nt to about 25 nt. In some cases, the total length of the adapter nucleic acid (including the 5' overhang) is from about 15 nt to about 30 nt. In some cases, the total length of the adapter nucleic acid (including the 5' overhang) is from about 25 nt to about 30 nt. In some cases, the total length of the adapter nucleic acid (including the 5' overhang) is from about 20 nt to about 50 nt. In some cases, the total length of the adapter nucleic acid (including the 5' overhang) is from about 25 nt to about 50 nt.

In some cases, the adapter nucleic acid comprises, in addition to the 5' overhang discussed above, a 3' overhang. In some cases, the adapter nucleic acid comprises, in addition to the 5' overhang discussed above, a 3' adenosine overhang.

The adapter nucleic acid is ligated to the PAM-distal cleavage product, to generate a ligation product comprising the adapter and the PAM-distal cleavage product. In some cases, the ligation product is further ligated to one or more additional adapters, e.g., an adapter that provides a bar code, an adapter that allows for next-generation sequencing, and the like. For example, the one or more additional adapters can include a nucleotide sequence specific for coupling to a sequencing platform; such an adapter may also include a barcode sequence. In some cases, the additional adapter comprises a nucleotide sequence that is at least 70% identical to a support-bound oligonucleotide conjugated to a solid support; in some cases, the solid support is coupled to a sequencing platform. In some cases, the additional adapter comprises a binding site for a sequencing primer. Ligation of various adapters to a type V CRISPR/Cas effector polypeptide cleavage product is depicted schematically in FIG. 3.

Double-stranded adapters can comprise two separate oligonucleotides hybridized to one another (also referred to as an "oligonucleotide duplex"), and hybridization may leave one or more blunt ends, one or more 3' overhangs, one or more 5' overhangs, one or more bulges resulting from mismatched and/or unpaired nucleotides, or any combination of these. In some embodiments, a single-stranded adapter comprises two or mores sequences that are able to hybridize with one another. When two such hybridizable sequences are contained in a single-stranded adapter, hybridization yields a hairpin structure (hairpin adapter). When two hybridized regions of an adapter are separated from one another by a non-hybridized region, a "bubble" structure results. Adapters comprising a bubble structure can consist of a single adapter oligonucleotide comprising internal hybridizations, or may comprise two or more adapter oligonucleotides hybridized to one another. Internal sequence hybridization, such as between two hybridizable sequences in an adapter, can produce a double-stranded structure in a single-stranded adapter oligonucleotide. Adapters of different kinds can be used in combination, such as a hairpin adapter and a double-stranded adapter, or adapters of different sequences. Hybridizable sequences in a hairpin adapter may or may not include one or both ends of the oligonucleotide. When neither of the ends are included in the hybridizable sequences, both ends are "free" or "overhanging." When only one end is hybridizable to another sequence in the adapter, the other end forms an overhang, such as a 3' overhang or a 5' overhang. When both the 5'-terminal nucleotide and the 3'-terminal nucleotide are included in the hybridizable sequences, such that the 5'-terminal nucleotide and the 3'-terminal nucleotide are complementary and hybridize with one another, the end is referred to as "blunt."

Adapters can contain one or more of a variety of sequence elements, including but not limited to, one or more amplification primer annealing sequences or complements thereof, one or more sequencing primer annealing sequences or complements thereof, one or more barcode sequences, one or more common sequences shared among multiple different adapters or subsets of different adapters, one or more restriction enzyme recognition sites, one or more overhangs complementary to one or more target polynucleotide overhangs, one or more probe binding sites (e.g. for attachment to a sequencing platform, such as a flow cell for massive parallel sequencing, such as developed by Illumina, Inc.), one or more random or near-random sequences (e.g. one or more nucleotides selected at random from a set of two or more different nucleotides at one or more positions, with each of the different nucleotides selected at one or more positions represented in a pool of adapters comprising the random sequence), and combinations thereof. Two or more sequence elements can be non-adjacent to one another (e.g. separated by one or more nucleotides), adjacent to one another, partially overlapping, or completely overlapping. For example, an amplification primer annealing sequence can also serve as a sequencing primer annealing sequence. Sequence elements can be located at or near the 3' end, at or near the 5' end, or in the interior of the adapter oligonucleotide. When an adapter oligonucleotide is capable of forming secondary structure, such as a hairpin, sequence elements can be located partially or completely outside the secondary structure, partially or completely inside the secondary structure, or in between sequences participating in the secondary structure. For example, when an adapter oligonucleotide comprises a hairpin structure, sequence elements can be located partially or completely inside or outside the hybridizable sequences (the "stem"), including in the sequence between the hybridizable sequences (the "loop"). In some cases, the first adapter oligonucleotides in a plurality of first adapter oligonucleotides having different barcode sequences comprise a sequence element common among all first adapter oligonucleotides in the plurality. In some cases, all second adapter oligonucleotides comprise a sequence element common among all second adapter oligonucleotides that is different from the common sequence element shared by the first adapter oligonucleotides. A difference in sequence elements can be any such that least a portion of different adapters do not completely align, for example, due to changes in sequence length, deletion or insertion of one or more nucleotides, or a change in the nucleotide composition at one or more nucleotide positions (such as a base change or base modification). In some cases, an adapter oligonucleotide comprises a 5' overhang, a 3' overhang, or both that is complementary to one or more target polynucleotides. Complementary overhangs can be one or more nucleotides in length, including but not limited to 1, 2, 3, 4, 5, 6, 7, 8, 9, 10, 11, 12, 13, 14, 15, or more nucleotides in length. Complementary overhangs may comprise a fixed sequence. Complementary overhangs may comprise a random sequence of one or more nucleotides, such that one or more nucleotides are selected at random from a set of two or more different nucleotides at one or more positions, with each of the different nucleotides selected at one or more positions represented in a pool of adapters with complementary overhangs comprising the random sequence. In some cases, an adapter overhang is complementary to a target polynucleotide overhang produced by restriction endonuclease digestion. In some embodiments, an adapter overhang consists of an adenine or a thymine.

The terms "joining" and "ligation" as used herein, with respect to two polynucleotides, such as an adapter nucleic acid and a PAM-distal cleavage product, refers to the covalent attachment of two separate polynucleotides to produce a single larger polynucleotide with a contiguous backbone. Methods for joining two polynucleotides are known in the art, and include without limitation, enzymatic and non-enzymatic (e.g. chemical) methods. Examples of ligation reactions that are non-enzymatic include the non-enzymatic ligation techniques described in U.S. Pat. Nos. 5,780,613 and 5,476,930, which are herein incorporated by reference. In some cases, an adapter nucleic acid is joined to a target polynucleotide (e.g., a PAM-distal cleavage product) by a ligase, for example a DNA ligase or RNA ligase. Multiple ligases, each having characterized reaction conditions, are known in the art, and include, without limitation NAD+-dependent ligases including tRNA ligase, Taq DNA ligase, *Thermus filiformis* DNA ligase, *Escherichia coli* DNA ligase, Tth DNA ligase, *Thermus scotoductus* DNA ligase (I and II), thermostable ligase, Ampligase thermostable DNA ligase, VanC-type ligase, 9° N DNA Ligase, Tsp DNA ligase, and novel ligases discovered by bioprospecting; ATP-dependent ligases including T4 RNA ligase, T4 DNA ligase, T3 DNA ligase, T7 DNA ligase, Pfu DNA ligase, DNA ligase 1, DNA ligase III, DNA ligase IV, and novel ligases discovered by bioprospecting; and wild-type, mutant isoforms, and genetically engineered variants thereof.

Ligation can be between polynucleotides having hybridizable sequences, such as complementary overhangs. Ligation can also be between two blunt ends. Generally, a 5' phosphate is utilized in a ligation reaction. The 5' phosphate can be provided by the target polynucleotide, the adapter oligonucleotide, or both. 5' phosphates can be added to or removed from polynucleotides to be joined, as needed. Methods for the addition or removal of 5' phosphates are known in the art, and include without limitation enzymatic and chemical processes. Enzymes useful in the addition and/or removal of 5' phosphates include kinases, phosphatases, and polymerases. In some cases, both of the two ends joined in a ligation reaction (e.g. an adapter end and a target polynucleotide end) provide a 5' phosphate, such that two covalent linkages are made in joining the two ends. In some cases, only one of the two ends joined in a ligation reaction (e.g. only one of an adapter end and a target polynucleotide end) provides a 5' phosphate, such that only one covalent linkage is made in joining the two ends. In some cases, only one strand at one or both ends of a target polynucleotide is joined to an adapter nucleic acid. In some cases, both strands at one or both ends of a target polynucleotide (e.g., a PAM-distal cleavage product) are joined to an adapter nucleic acid. In some cases, 3' phosphates are removed prior to ligation. In some cases, an adapter nucleic acid is added to only one end of a target polynucleotide (e.g., a PAM-distal cleavage product). When both strands at both ends are joined to an adapter oligonucleotide, joining can be followed by a cleavage reaction that leaves a 5' overhang that can serve as a template for the extension of the corresponding 3' end, which 3' end may or may not include one or more nucleotides derived from the adapter oligonucleotide. In some cases, a target polynucleotide (e.g., a PAM-distal cleavage product) is joined to a first adapter nucleic acid on one end and a second adapter oligonucleotide on the other end. In some cases, two ends of a target polynucleotide are joined to the opposite ends of a single adapter oligonucleotide. In some cases, the target polynucleotide and the adapter nucleic acid to which it is joined comprise blunt ends. In some cases, separate ligation reactions are carried out for each sample, using a different first adapter nucleic acid comprising at least one barcode sequence for each sample, such that no barcode sequence is joined to the target polynucleotides of more than one sample. A target polynucleotide that has an adapter nucleic acid joined to it is considered "tagged" by the joined adapter.

In some cases, the primers are spiked primers, as described in Example 2. In some cases, a method of the present disclosure comprises use of metagenomic sequencing with spiked primer enrichment (MSSPE), as described in Example 2.

Amplification

As noted above, a sample comprising a target DNA can be subjected to one or more nucleic acid amplification steps before the contacting step. The sample can be subjected to one or more amplification steps prior to the contacting step, with primers that provide for amplification of nucleic acids of, e.g., specific pathogens, categories of pathogens, two or more different pathogens, or two or more different categories of pathogens.

Oligonucleotide Primers

A sample comprising a target DNA can be amplified using a method comprising contacting the sample with one or more pairs of nucleic acid primers. For example, in some cases, the sample is contacted with a single pair of nucleic acid primers (also referred to herein as "oligonucleotide primers" or, simply, "primers"). In some cases, the sample is contacted with two or more different pairs of primers; e.g., the sample is contacted with 2, 3, 4, 5, 6, 7, 8, 9, or 10, or more than 10 (e.g., from 10 to 15, from 15 to 20, from 20 to 25, or from 25 to 30), different pairs of primers. The term "different pairs of primers" refers to primer pairs that differ from one another in nucleotide sequence. For example, a first primer pair differs from a second primer pair in nucleotide sequence, where the first and second primer pairs are "different pairs of primers."

In some cases, the two or more different primer pairs provide for amplification of DNA from two or more different pathogens. In some cases, the two or more different primer pairs provide for amplification of DNA from two or more (e.g., 2, 3, 4, 5, 6, 7, 8, 9, 10, or more than 10 (e.g., from 10 to 15, from 15 to 20, from 20 to 25, or from 25 to 30)), different pathogens. In some cases, the two or more pathogens are viral pathogens. In some cases, the two or more pathogens are bacterial pathogens. In some cases, the two or more pathogens are helminths. In some cases, the two or more pathogens are protozoa. In some cases, the two or more pathogens are fungal pathogens.

In some case, the two or more different primer pairs provide for amplification of DNA from two or more categories of pathogens. For example, in some cases, the two or more different primer pairs provide for amplification of DNA from: two or more different hemorrhagic fever viruses. As another example, in some cases, the two or more different primer pairs provide for amplification of DNA of two or more different blood-borne pathogens. As another example, in some cases, the two or more different primer pairs provide for amplification of DNA of two or more different tick-borne pathogens. As another example, in some cases, the two or more different primer pairs provide for amplification of DNA of two or more different mosquito-borne pathogens. As another example, in some cases, the two or more different primer pairs provide for amplification of DNA of two or more antibiotic-resistant pathogens.

For example, forward and reverse primers that can be used in connection with detection of viral pathogens (i.e., that can be used to amplify a target nucleic acid of a viral pathogen) are set out in SEQ ID Nos:71 to 6432). The primers include primers suitable for amplifying Chikungunya virus (CHIKV), Dengue virus (DENV), Ebola virus, Hepatitis C virus (HCV), Hepatitis E virus (HEV), human immunodeficiency virus (HIV), Lassa virus, Marburg virus, measles virus, RVF, West Nile Virus (WNV), Yellow fever virus (YFV), and Zika virus (ZIKV). As another example, forward and reverse primers that can be used in connection with tick-borne diseases (i.e., that can be used to amplify a target nucleic acid of a tick-borne pathogen) are set out in SEQ ID Nos: 6433 to 13607. As yet another example, primers suitable for use in connection with detection of antibiotic resistance genes (e.g., nucleic acids that encode antibiotic resistance factors) are depicted in SEQ ID Nos: 13608 to 17378. Examples of target nucleic acids in the context of antibiotic resistance are depicted in FIG. 8. Any of the forward primers can be paired with any of the reverse primers set out in the aforementioned figures, as long as the target nucleotide sequence to which the forward primer hybridizes is 5' of the target nucleotide sequence to which the reverse primer hybridizes.

In some cases, the primers are spiked primers, as described in Example 2. In some cases, a method of the present disclosure comprises use of metagenomic sequencing with spiked primer enrichment (MSSPE), as described in Example 2.

Amplification Methods

Various amplification methods and components will be known to one of ordinary skill in the art and any convenient method can be used (see, e.g., Zanoli and Spoto, Biosensors (Basel). 2013 March, 3(1): 18-43; Gill and Ghaemi, Nucleosides, Nucleotides, and Nucleic Acids, 2008, 27: 224-243; Craw and Balachandrana, Lab Chip, 2012, 12, 2469-2486; which are herein incorporated by reference in their entirety). Nucleic acid amplification can comprise polymerase chain reaction (PCR), reverse transcription PCR (RT-PCR), quantitative PCR (qPCR), reverse transcription qPCR (RT-qPCR), nested PCR, multiplex PCR, asymmetric PCR, touchdown PCR, random primer PCR, hemi-nested PCR, polymerase cycling assembly (PCA), colony PCR, ligase chain reaction (LCR), digital PCR, methylation specific-PCR (MSP), co-amplification at lower denaturation temperature-PCR (COLD-PCR), allele-specific PCR, intersequence-specific PCR (ISS-PCR), whole genome amplification (WGA), inverse PCR, and thermal asymmetric interlaced PCR (TAIL-PCR).

In some cases, the amplification is isothermal amplification. The term "isothermal amplification" indicates a method of nucleic acid (e.g., DNA) amplification (e.g., using enzymatic chain reaction) that can use a single temperature incubation thereby obviating the need for a thermal cycler. Isothermal amplification is a form of nucleic acid amplification which does not rely on the thermal denaturation of the target nucleic acid during the amplification reaction and hence may not require multiple rapid changes in temperature. Isothermal nucleic acid amplification methods can therefore be carried out inside or outside of a laboratory environment. By combining with a reverse transcription step, these amplification methods can be used to isothermally amplify RNA.

Examples of isothermal amplification methods include, but are not limited to, loop-mediated isothermal Amplification (LAMP), helicase-dependent Amplification (HDA), recombinase polymerase amplification (RPA), strand displacement amplification (SDA), nucleic acid sequence-based amplification (NASBA), transcription mediated amplification (TMA), nicking enzyme amplification reaction (NEAR), rolling circle amplification (RCA), multiple displacement amplification (MDA), Ramification (RAM), circular helicase-dependent amplification (cHDA), single primer isothermal amplification (SPIA), signal mediated amplification of RNA technology (SMART), self-sustained sequence replication (3SR), genome exponential amplification reaction (GEAR) and isothermal multiple displacement amplification (IMDA).

In some cases, the amplification is recombinase polymerase amplification (RPA) (see, e.g., U.S. Pat. Nos. 8,030, 000; 8,426,134; 8,945,845; 9,309,502; and 9,663,820, which are hereby incorporated by reference in their entirety). Recombinase polymerase amplification (RPA) uses two opposing primers (much like PCR) and employs three enzymes—a recombinase, a single-stranded DNA-binding protein (SSB) and a strand-displacing polymerase. The recombinase pairs oligonucleotide primers with homologous sequence in duplex DNA, SSB binds to displaced strands of DNA to prevent the primers from being displaced, and the strand displacing polymerase begins DNA synthesis where the primer has bound to the target DNA. Adding a reverse transcriptase enzyme to an RPA reaction can facilitate detection RNA as well as DNA, without the need for a separate step to produce cDNA. One example of components for an RPA reaction is as follows (see, e.g., U.S. Pat. Nos. 8,030, 000; 8,426,134; 8,945,845; 9,309,502; 9,663,820): 50 mM Tris pH 8.4, 80 mM Potassium actetate, 10 mM Magnesium acetate, 2 mM DTT, 5% PEG compound (Carbowax-20M), 3 mM ATP, 30 mM Phosphocreatine, 100 ng/μl creatine kinase, 420 ng/μl gp32, 140 ng/μl UvsX, 35 ng/μl UvsY, 2000M dNTPs, 300 nM each oligonucleotide, 35 ng/μl Bsu polymerase, and a nucleic acid-containing sample).

In a transcription-mediated amplification (TMA) method, an RNA polymerase is used to make RNA from a promoter engineered in the primer region; then a reverse transcriptase synthesizes cDNA from the primer. A third enzyme, e.g., Rnase H, can then be used to degrade the RNA target from cDNA without the heat-denatured step. This amplification technique is similar to Self-Sustained Sequence Replication (3SR) and Nucleic Acid Sequence Based Amplification (NASBA), but varies in the enzymes employed. As another example, helicase-dependent amplification (HDA) utilizes a thermostable helicase (Tte-UvrD) rather than heat to unwind dsDNA to create single-strands that are then available for hybridization and extension of primers by polymerase. As yet another example, a loop-mediated amplification (LAMP) method employs a thermostable polymerase with strand displacement capabilities and a set of four or more specific designed primers. Each primer is designed to have hairpin ends that, once displaced, snap into a hairpin to facilitate self-priming and further polymerase extension. In a LAMP reaction, though the reaction proceeds under isothermal conditions, an initial heat denaturation step is required for double-stranded targets. In addition, amplification yields a ladder pattern of various length products. As yet another example, a strand displacement amplification (SDA) combines the ability of a restriction endonuclease to nick the unmodified strand of its target DNA and an exonuclease-deficient DNA polymerase to extend the 3' end at the nick and displace the downstream DNA strand.

Target RNA

In some cases, a target DNA present in a sample is generated from an RNA template. Any known method of generating DNA from an RNA template can be used. For example, a reverse transcriptase can be used to generate a target DNA from a target RNA.

Sequencing

As noted above, a subject method of characterizing a target DNA in a sample comprises ligating an adapter nucleic acid with a PAM-distal cleavage product, generating a ligation product comprising the adapter and the PAM-distal cleavage product. The PAM-distal cleavage product includes at least a portion of the target DNA. Thus, the ligation product includes at least a portion of the target DNA. The nucleotide sequence of the at least a portion of the target DNA present in the ligation product can be determined. The nucleotide sequence can be determined using any of a variety of methods for determining the nucleotide sequence of DNA.

In some cases, the nucleotide sequence is determined using next generation sequencing.

The term "next generation sequencing" (NGS) refers to the so-called highly parallelized methods of performing nucleic acid sequencing and comprises the sequencing-by-synthesis or sequencing-by-ligation platforms currently employed by Illumina, Life Technologies, Pacific Biosciences and Roche, etc. Next generation sequencing methods also include, but are not limited to, nanopore sequencing methods such as those offered by Oxford Nanopore, and electronic detection-based methods such as the Ion Torrent technology commercialized by Life Technologies.

As would be apparent to those skilled in the art, the ligation product may be amplified using primers that hybridize to the adapter present in the ligation product, thereby producing amplification products. In some cases, the primers used to amplify the fragments have a 5' tail that provides compatibility with a particular sequencing platform. In certain cases, one or more of the primers used in this step may additionally contain a sample identifier (e.g., a bar code). If the primers have a sample identifier, then products from different samples can be pooled prior to sequencing. In some cases, this amplifying step may comprise appending a sample identifier sequence to the amplified fragments.

As would be apparent to those skilled in the art, the adapters and/or the primers used for amplification may be compatible with use in a next generation sequencing platform, e.g., Illumina's reversible terminator method, Roche's pyrosequencing method (454), Life Technologies' sequencing by ligation (the SOLiD platform), Life Technologies' Ion Torrent platform or Oxford Nanopore's MinIon system. Examples of such methods are described in the following references: Margulies et al. (Nature 2005 437: 376-80); Ronaghi et al. (Analytical Biochemistry 1996 242: 84-9); Shendure (Science 2005 309: 1728); Imelfort et al. (Brief Bioinform. 2009 10:609-18); Fox et al. (Methods Mol Biol. 2009; 553:79-108); Appleby et al. (Methods Mol Biol. 2009; 513:19-39) and Morozova (Genomics. 2008 92:255-64), which are incorporated by reference for the general descriptions of the methods and the particular steps of the methods, including all starting products, reagents, and final products for each of the steps. The present method may be used on any sequencing platform, including those that are based on sequencing-by-synthesis (i.e., by extending a primer that is hybridized to a template).

The DNA sequencing technology can utilize the Ion Torrent sequencing platform, which pairs semiconductor technology with a sequencing chemistry to directly translate chemically encoded information (A, C, G, T) into digital information (0, 1) on a semiconductor chip. Without wishing to be bound by theory, when a nucleotide is incorporated into a strand of DNA by a polymerase, a hydrogen ion is released as a byproduct. The Ion Torrent platform detects the release of the hydrogen atom as a change in pH. A detected change in pH can be used to indicate nucleotide incorporation. The Ion Torrent platform comprises a high-density array of micro-machined wells to perform this biochemical process in a massively parallel way. Each well holds a different library member, which may be clonally amplified. Beneath the wells is an ion-sensitive layer and beneath that an ion sensor. The platform sequentially floods the array with one nucleotide after another. When a nucleotide, for example a C, is added to a DNA template and is then incorporated into a strand of DNA, a hydrogen ion will be released. The charge from that ion will change the pH of the solution, which can be identified by Ion Torrent's ion sensor. If the nucleotide is not incorporated, no voltage change will be recorded and no base will be called. If there are two identical bases on the DNA strand, the voltage will be double, and the chip will record two identical bases called. Direct identification allows recordation of nucleotide incorporation in seconds. Library preparation for the Ion Torrent platform generally involves ligation of two distinct adaptors at both ends of a DNA fragment.

The DNA sequencing technology can utilize an Illumina sequencing platform, which generally employs cluster amplification of library members onto a flow cell and a sequencing-by-synthesis approach. Cluster-amplified library members are subjected to repeated cycles of polymerase-directed single base extension. Single-base extension can involve incorporation of reversible-terminator dNTPs, each dNTP labeled with a different removable fluorophore. The reversible-terminator dNTPs are generally 3' modified to prevent further extension by the polymerase. After incorporation, the incorporated nucleotide can be identified by fluorescence imaging. Following fluorescence imaging, the fluorophore can be removed and the 3' modification can be removed resulting in a 3' hydroxyl group, thereby allowing another cycle of single base extension. Library preparation for the Illumina platform generally involves ligation of two distinct adaptors at both ends of a DNA fragment.

The DNA sequencing technology that is used can be the Helicos True Single Molecule Sequencing (tSMS), which can employ sequencing-by-synthesis technology. In the tSMS technique, a polyA adaptor can be ligated to the 3' end of DNA fragments. The adapted fragments can be hybridized to poly-T oligonucleotides immobilized on the tSMS flow cell. The library members can be immobilized onto the flow cell at a density of about $10^8$ templates/cm$^2$. The flow cell can be then loaded into an instrument, e.g., HeliScope™ sequencer, and a laser can illuminate the surface of the flow cell, revealing the position of each template. A CCD camera can map the position of the templates on the flow cell surface. The library members can be subjected to repeated cycles of polymerase-directed single base extension. The sequencing reaction begins by introducing a DNA polymerase and a fluorescently labeled nucleotide. The polymerase can incorporate the labeled nucleotides to the primer in a template directed manner. The polymerase and unincorporated nucleotides can be removed. The templates that have directed incorporation of the fluorescently labeled nucleotide can be discerned by imaging the flow cell surface.

After imaging, a cleavage step can remove the fluorescent label, and the process can be repeated with other fluorescently labeled nucleotides until a desired read length is achieved. Sequence information can be collected with each nucleotide addition step.

The DNA sequencing technology can utilize a SOLiD™ technology (Applied Biosystems). The SOLiD platform generally utilizes a sequencing-by-ligation approach. Library preparation for use with a SOLiD platform generally comprises ligation of adapters to the 5' and 3' ends of the DNA fragments (e.g., ligation products) to be sequenced to generate a fragment library. Alternatively, internal adapters can be introduced by ligating adapters to the 5' and 3' ends of the fragments, circularizing the fragments, digesting the circularized fragment to generate an internal adaptor, and attaching adaptors to the 5' and 3' ends of the resulting fragments to generate a mate-paired library. Next, clonal bead populations can be prepared in microreactors containing beads, primers, template, and PCR components. Following PCR, the templates can be denatured. Beads can be enriched for beads with extended templates. Templates on the selected beads can be subjected to a 3' modification that permits bonding to a glass slide. The sequence can be determined by sequential hybridization and ligation of partially random oligonucleotides with a central determined base (or pair of bases) that is identified by a specific fluorophore. After a color is recorded, the ligated oligonucleotide can be removed and the process can then be repeated.

The DNA sequencing technology can utilize a single molecule, real-time (SMRT™) sequencing platform (Pacific Biosciences). In SMRT sequencing, the continuous incorporation of dye-labeled nucleotides can be imaged during DNA synthesis. Single DNA polymerase molecules can be attached to the bottom surface of individual zero-mode wavelength identifiers (ZMW identifiers) that obtain sequence information while phospholinked nucleotides are being incorporated into the growing primer strand. A ZMW generally refers to a confinement structure which enables observation of incorporation of a single nucleotide by DNA polymerase against a background of fluorescent nucleotides that rapidly diffuse in an out of the ZMW on a microsecond scale. By contrast, incorporation of a nucleotide generally occurs on a milliseconds timescale. During this time, the fluorescent label can be excited to produce a fluorescent signal, which is detected. Detection of the fluorescent signal can be used to generate sequence information. The fluorophore can then be removed, and the process repeated. Library preparation for the SMRT platform generally involves ligation of hairpin adaptors to the ends of DNA fragments.

The DNA sequencing technology can utilize nanopore sequencing (e.g. as described in Soni G V and Meller A. Clin Chem 53: 1996-2001 (2007)). Nanopore sequencing DNA analysis techniques are being industrially developed by a number of companies, including Oxford Nanopore Technologies (Oxford, United Kingdom). Nanopore sequencing is a single-molecule sequencing technology whereby a single molecule of DNA is sequenced directly as it passes through a nanopore. A nanopore can be a small hole, of the order of 1 nanometer in diameter. Immersion of a nanopore in a conducting fluid and application of a potential (voltage) across can result in a slight electrical current due to conduction of ions through the nanopore. The amount of current which flows is sensitive to the size and shape of the nanopore and to occlusion by, e.g., a DNA molecule. As a DNA molecule passes through a nanopore, each nucleotide on the DNA molecule obstructs the nanopore to a different degree, changing the magnitude of the current through the nanopore in different degrees. Thus, this change in the current as the DNA molecule passes through the nanopore represents a reading of the DNA sequence.

The DNA sequencing technology can utilize a chemical-sensitive field effect transistor (chemFET) array (e.g., as described in U.S. Patent Application Publication No. 20090026082). In one example of the technique, DNA molecules can be placed into reaction chambers, and the template molecules can be hybridized to a sequencing primer bound to a polymerase. Incorporation of one or more triphosphates into a new nucleic acid strand at the Y end of the sequencing primer can be discerned by a change in current by a chemFET. An array can have multiple chemFET sensors. In another example, single nucleic acids can be attached to beads, and the nucleic acids can be amplified on the bead, and the individual beads can be transferred to individual reaction chambers on a chemFET array, with each chamber having a chemFET sensor, and the nucleic acids can be sequenced.

Target Nucleic Acids

A target nucleic acid can be single stranded (ssDNA), a double stranded (dsDNA), or an RNA.

Where the target DNA is a ssDNA, the ssDNA can be used as a template for second strand synthesis, to generate a dsDNA. Where the target nucleic acid is an RNA, the RNA can be used as a template for reverse transcriptase, to generate a complementary DNA (cDNA); and the cDNA can be used as a template for second strand synthesis, to generate a dsDNA.

When the target DNA is single stranded, there is no preference or requirement for a PAM sequence in the target DNA. However, when the target DNA is dsDNA, a PAM is usually present adjacent to the target sequence of the target DNA (e.g., see discussion of the PAM elsewhere herein). The source of the target DNA can be the same as the source of the sample, e.g., as described below.

The source of the target nucleic acid can be from any source. In some cases, the target DNA is DNA of a pathogen. In some cases, the target nucleic acid is not from a pathogenic organism. In some cases, the target DNA is from a mammal. In some cases, the target nucleic acid is from a plant.

In some cases, the target nucleic acid is DNA or RNA of a pathogen (e.g., a pathogen that infects a human; a pathogen that infects a non-human mammal; a pathogen that infects a bird; a pathogen that infects a reptile; a pathogen that infects an amphibian; a pathogen that infects a fish; a pathogen that infects a plant; etc.).

In some cases, the target nucleic acid is a not from a pathogenic organism. For example, in some cases, the target nucleic acid is fetal DNA from a human.

In some cases, the target DNA is a viral DNA (e.g., a genomic DNA of a DNA virus). In some cases, the target DNA is bacterial DNA. In some cases, the target DNA is DNA of a protozoan. In some cases, the target DNA is DNA of a helminth. In some cases, the target DNA is DNA of a fungus.

The target nucleic acid can be from a bacterium, such as *Bacillus* (e.g., *B. anthracis*), Enterobacteriaceae (e.g., *Salmonella, Escherichia coli, Yersinia pestis, Klebsiella*, and *Shigella*), *Yersinia* (e.g., *Y. pestis* or *Y. enterocolitica*), *Staphylococcus* (e.g., *S. aureus*), *Streptococcus, Gonorrheae, Enterococcus* (e.g., *E. faecalis*), *Listeria* (e.g., *L. monocytogenes*), *Brucella* (e.g., *B. abortus, B. melitensis*, or *B. suis*), *Vibrio* (e.g., *V. cholerae*), *Corynebacterium diphtheria, Pseudomonas* (e.g., *P. pseudomallei* or *P. aerugi-*

*nosa*), *Burkholderia* (e.g., *B. mallei* or *B. pseudomallei*), *Shigella* (e.g., *S. dysenteriae*), *Rickettsia* (e.g., *R. rickettsii, R. prowazekii*, or *R. typhi*), *Francisella tularensis, Chlamydia psittaci, Coxiella burnetii, Mycoplasma* (e.g., *M. mycoides*), etc.

The target nucleic acid can be from a virus, such as Adenoviridae (e.g., adenovirus), Arenaviridae (e.g., Machupo virus), Bunyaviridae (e.g., Hantavirus or Rift Valley fever virus), Coronaviridae, Orthomyxoviridae (e.g., influenza viruses), Filoviridae (e.g., Ebola virus and Marburg virus), Flaviviridae (e.g., Japanese encephalitis virus and Yellow fever virus), Hepadnaviridae (e.g., hepatitis B virus), Herpesviridae (e.g., herpes simplex viruses), Papovaviridae (e.g., papilloma viruses), Paramyxoviridae (e.g., respiratory syncytial virus, measles virus, mumps virus, or parainfluenza virus), Parvoviridae, Picornaviridae (e.g., polioviruses), Poxviridae (e.g., variola viruses), Reoviridae (e.g., rotaviruses), Retroviridae (e.g., human T cell lymphotropic viruses (HTLV) and human immunodeficiency viruses (HIV)), Rhabdoviridae (e.g., rabies virus), and Togaviridae (e.g., encephalitis viruses, yellow fever virus, and rubella virus)). Where the virus is a ssDNA virus, the ssDNA can be used as a template for second strand synthesis, to generate a dsDNA. Where the virus is an RNA virus, the RNA can be used as a template for reverse transcriptase, to generate a complementary DNA (cDNA); and the cDNA can be used as a template for second strand synthesis, to generate a dsDNA.

The target nucleic acid can be from a protozoon, such as *Cryptosporidium parvum*, Encephalitozoa, *Plasmodium* (e.g., *Plasmodium falciparum*), *Toxoplasma gondii, Acanthamoeba, Entamoeba histolytica, Giardia lamblia, Trichomonas vaginalis, Leishmania*, or *Trypanosoma* (e.g., *T. brucei; T. cruzi*); etc.

The target nucleic acid can be from a helminth, such as cestodes (tapeworms), trematodes (flukes), or nematodes (roundworms, e.g., *Ascaris lumbricoides, Trichuris trichiura, Necator americanus*, or *Ancylostoma duodenale*); etc.

The target nucleic acid can be from a fungus, such as Aspergilli, Candidae, *Coccidioides immitis*, and Cryptococci.

Examples of possible target nucleic acids include, but are not limited to, viral nucleic acids such as: a papovavirus (e.g., human papillomavirus (HPV), polyomavirus); a hepadnavirus (e.g., Hepatitis B Virus (HBV)); a herpesvirus (e.g., herpes simplex virus (HSV), varicella zoster virus (VZV), Epstein-Barr virus (EBV), cytomegalovirus (CMV), herpes lymphotropic virus, *Pityriasis Rosea*, kaposi's sarcoma-associated herpesvirus); an adenovirus (e.g., atadenovirus, aviadenovirus, ichtadenovirus, mastadenovirus, siadenovirus); a poxvirus (e.g., smallpox, vaccinia virus, cowpox virus, monkeypox virus, orf virus, pseudocowpox, bovine papular stomatitis virus; tanapox virus, yaba monkey tumor virus; molluscum contagiosum virus (MCV)); a parvovirus (e.g., adeno-associated virus (AAV), Parvovirus B19, human bocavirus, bufavirus, human parv4 GI); Geminiviridae; Nanoviridae; Phycodnaviridae; Zika virus; and the like.

In some cases, the target nucleic acid is from a viral pathogen selected from among Adenoviruses, Alphaviruses (Togaviruses), Eastern equine encephalitis virus, Eastern equine encephalomyelitis virus, Venezuelan equine encephalomyelitis vaccine strain TC-83, Western equine encephalomyelitis virus, Arenaviruses, Lymphocytic choriomeningitis virus (non-neurotropic strains), Tacaribe virus complex, Bunyaviruses, Bunyamwera virus, Rift Valley fever virus vaccine strain MP-12, Calciviruses, Coronaviruses. Flaviviruses (Togaviruses)-Group B Arboviruses, Dengue virus serotypes 1, 2, 3, and 4, Yellow fever virus vaccine strain 17D, Hepatitis A, B, C, D, and E viruses, the Cytomegalovirus, Epstein Barr virus, Herpes simplex types 1 and 2, Herpes zoster, Human herpesvirus types 6 and 7, Influenza viruses types A, B, and C, Papovaviruses, Papilloma viruses, Newcastle disease virus, Measles virus, Mumps virus, Parainfluenza viruses types 1, 2, 3, and 4, polyomaviruses (JC virus, BK virus), Respiratory syncytial virus, Human parvovirus (B 19), Coxsackie viruses types A and B, Echoviruses, Polioviruses, Rhinoviruses, Alastrim (*Variola minor* virus), Smallpox (*Variola major* virus), Whitepox Reoviruses, Coltivirus, human Rotavirus, and Orbivirus (Colorado tick fever virus), Rabies virus, Vesicular stomatitis virus, Rubivirus (rubella), Semliki Forest virus, St. Louis encephalitis virus, Venezuelan equine encephalitis virus, Venezuelan equine encephalomyelitis virus, Arenaviruses (a.k.a. South American Hemorrhagic Fever virus), Flexal, Lymphocytic choriomeningitis virus (LCM) (neurotropic strains), Hantaviruses including Hantaan virus, Rift Valley fever virus, Japanese encephalitis virus, Yellow fever virus, Monkeypox virus, Human immunodeficiency virus (HIV) types 1 and 2, Human T cell lymphotropic virus (HTLV) types 1 and 2, Simian immunodeficiency virus (SIV), Vesicular stomatitis virus, Guanarito virus, Lassa fever virus, Junin virus, Machupo virus, Sabia, Crimean-Congo hemorrhagic fever virus, Ebola viruses, Marburg virus, Tick-borne encephalitis virus complex (flavi) including Central European tick-borne encephalitis, Far Eastern tick-borne encephalitis, Hanzalova, Hypr, Kumlinge, Kyasanur Forest disease, Omsk hemorrhagic fever, and Russian Spring Summer encephalitis viruses, Herpesvirus simiae (Herpes B or Monkey B virus), Cercopithecine herpesvirus 1 (Herpes B virus), Equine morbillivirus (Hendra and Hendra-like viruses), Nipah virus, *Variola major* virus (Smallpox virus), *Variola minor* virus (Alastrim), African swine fever virus, African horse sickness virus, Akabane virus, Avian influenza virus (highly pathogenic), Blue tongue virus, Camel pox virus, Classical swine fever virus, *Cowdria ruminantium* (heartwater), Foot and mouth disease virus, Goat pox virus, Japanese encephalitis virus, Lumpy skin disease virus, Malignant catarrhal fever virus, Menangle virus, Newcastle disease virus (VVND), Peste Des Petits Ruminants virus, Rinderpest virus, Sheep pox virus, Swine vesicular disease virus, and Vesicular stomatitis virus (exotic).

In some cases, the target nucleic acid is bacterial DNA, e.g., DNA of a pathogenic bacterium. In some embodiments, the bacterial pathogen is selected from among *Acinetobacter baumannii* (formerly *Acinetobacter calcoaceticus*); *Actinobacillus; Actinomyces pyogenes* (formerly *Corynebacterium pyogenes*); *Actinomyces israelii; Nocardia asteroides; N. brasiliensis; Aeromonas hydrophila; Amycolata autotrophica; Archanobacterium haemolyticum* (formerly *Corynebacterium haemolyticum*); *Arizona hinshawii*—all serotypes; *Bacillus anthracis; Bacteroides fragilis; Bartonella henselae; B. quintana; B. vinsonii; Bordetella* including *B. pertussis; Borrelia recurrentis; B. burgdorferi; Burkholderia* (formerly *Pseudomonas* species), *Campylobacter coli, C. fetus, C. jejuni, Chlamydia psittaci, C. trachomatis, C. pneumonia, Clostridium botulinum* (neurotoxin producing species), *Cl. chauvoei, Cl. haemolyticum, Cl. histolyticum, Cl. novyi, Cl. septicum, Cl. tetani, Cl. perfringens, Corynebacterium diphtheriae, C. pseudotuberculosis, C. renale, Dermatophilus congolensis, Edwardsiella tarda, Erysipelothrix rhusiopathiae, Escherichia coli*—all enteropathogenic, enterotoxigenic, enteroinvasive and strains bearing K1 antigen, including *E. coli* O157:H7; *Haemophilus ducreyi, H. influenzae; Helicobacter pylori, Klebsiella*—all species; *Legionella* including *L. pneumophila; Leptospira interrogans*—all serotypes; *Listeria, Moraxella, Mycobacterium*, including *M. avium* complex, *M. asiaticum, M. bovis* BCG vaccine strain, *M. chelonei, M. fortuitum, M. kansasii, M. leprae, M. malmoense, M. marinum, M. paratuberculosis, M. scrofulaceum, M. simiae, M. szulgai, M. ulcerans, M. xenopi; Mycoplasma; Neisseria gonorrhoeae, N. meningitides, Nocardia asteroides, N. brasiliensis, N. otitidiscaviarum, N. transvalensis; Proteus mirabilis; P. vulgaris; Rhodococcus equi; Salmonella* including *S. arizonae, S. cholerasuis, S. enteritidis, S. gallinarum-pullorum, S. meleagridis, S. paratyphi*, A, B, C, *S. typhi; S. typhimurium; Shigella* including *S. boydii, S. dysenteriae*, type 1, *S. flexneri, S. sonnei; Sphaerophorus necrophorus; Staphylococcus aureus; Streptobacillus moniliformis; Streptococcus* including *S. pneumoniae, S. pyogenes; Treponema pallidum, T. carateum; Vibrio cholerae, V. parahemolyticus, V. vulnificus; Yersinia enterocolitica; Bartonella; Brucella* including *B. abortus, B. canis, B. suis, B. melitensis; Burkholderia (Pseudomonas) mallei; B. pseudomallei; Coxiella burnetiid; Francisella tularensis; Mycobacterium bovis, M. tuberculosis*, Mycobacteria; *Pasteurella multocida* type B—"buffalo" and other virulent strains; *Rickettsia akari, R. australis, R. canada, R. conorii, R. prowazekii, R. rickettsii, R. siberica, R. tsutsugamushi, R. typhi (R. moosert)*; and *Yersinia pestis*.

In some cases, the target nucleic acid is a nucleic acid of a parasite, e.g., a parasite selected from among *Ancylostoma* human hookworms including *A. duodenale, A. ceylanicum; Ascaris* including *Ascaris lumbricoides suum; Babesia* including *B. divergens, B. microti; Brugia filaria* worms including *B. malayi, B. timori*; Coccidia; *Cryptosporidium* including *C. parvum; Cysticercus cellulosae* (hydatid cyst, larva of *T. solium); Echinococcus* including *E. granulosis, E. multilocularis, E. vogeli; Entamoeba histolytica; Enterobius; Fasciola* including *F. gigantica, F. hepatica, Giardia* including *G. lamblia; Heterophyes; Hymenolepis* including *H. diminuta, H. nana; Isospora; Leishmania* including *L. braziliensis, L. donovani, L. ethiopia, L. major, L. mexicana, L. peruvania, L. tropica; Loa loa filaria* worms, *Microsporidium; Naegleria fowleri*; Necator human hookworms including *N. americanus, Onchocerca filaria* worms including, *O. volvulus; Plasmodium cynomologi, P. falciparum, P. malariae, P. ovale, P. vivax; Sarcocystis* including *S. sui hominis; Schistosoma* including *S. haematobium, S. intercalatum, S. japonicum, S. mansoni, S. mekongi; Strongyloides* including *S. stercoralis; Taenia solium; Toxocara* including *T. canis; Toxoplasma* including *T. gondii; Trichinella spiralis; Trypanosoma* including *T. brucei brucei, T. brucei gambiense, T. brucei rhodesiense, T. cruzi*; and *Wuchereria bancrofti filaria* worms.

In some cases, the target nucleic acid is nucleic acid of a fungus, e.g., from a fungal pathogen selected from among *Aspergillus fumigates, Blastomyces dermatitidis, Cladosporium bantianum, Candida albicans, C. (Xylohypha) trichoides, Cryptococcus neoformans, Dactylaria galopava (Ochroconis gallopavum), Epidermophyton, Exophiala (Wangiella) dermatitidis, Fonsecaea pedrosoi, Microsporum, Paracoccidioides braziliensis, Penicillium marnefei, Pneumocystis carinii, Sporothrix schenckii, Trichophyton, Coccidioides immitis, Coccidioides posadasii, Histoplasma capsulatum*, and *H. capsulatum* var. *duboisii*.

In some cases, the drug resistant pathogen is selected from the group consisting of vancomycin-resistant *Enterococcus faecium*, methicillin-resistant *Staphylococcus aureus*, penicillin-resistant *Streptococcus pneumoniae*, multi-drug resistant *Mycobacterium tuberculosis*, and AZT-resistant human immunodeficiency virus.

Target nucleic acids can include, e.g., 16S ribosomal RNA (rRNA), e.g., where the target nucleic acid is a nucleic acid of a bacterium (e.g., *Anaplasma, Bartonella, Borrelia burgdoferi, Borrelia miyamotoi, Brucella, Chlamydophila, Coxiella, Francisella, Rickettsia*, etc.). Target nucleic acids can encompass the entire genome (e.g., where the target nucleic acid is a nucleic acid of a viral pathogen).

Target nucleic acids also include any nucleic acid from a bacterium, fungus, or parasite that is used for identification and genotyping.

In some cases, the target nucleic acid is a particular segment or coding region of a nucleic acid. For example, for certain viruses, a nucleic acid encoding a structural polyprotein can be the target nucleic acid. As another example, for certain viruses, an L segment nucleic acid can be the target nucleic acid. As another example, for certain viruses, a nucleic acid encoding an NS5 polypeptide can be the target nucleic acid.

For example, for Colorado tick fever virus, segment 1 can be the target nucleic acid. As another example, for Epstein-Barr Virus, a nucleic acid encoding nuclear protein can be the target nucleic acid. As another example, for Eastern Equine Encephalitis Virus, a nucleic acid encoding a structural polyprotein can be the target nucleic acid. As another example, for Hanta virus, Heartland virus, La Crosse Virus, Lymphocytic Choriomeningitis Virus, Sin Nombre Virus, an L segment nucleic acid can be the target nucleic acid.

In some cases, e.g., where the target nucleic acid is a nucleic acid of a fungus (e.g., *Apophysomyces, Aspergillus, Blastomyces, Candida, Coccidiodes, Cryptococcus, Cunninghamela, Fusarium, Histoplasma, Lichteimia, Murcor, Rhizopus*, and the like), an internal transcribed spacer 1 (ITS1) gene can be the target nucleic acid.

In some cases, e.g., where the target nucleic acid is a nucleic acid of a parasite (e.g., *Acanthamoeba, Angiostrongylus, Ascaris, Babesia, Balamuthia, Blastocytis, Brugia, Cyclospora, Echinococcus, Entamoeba, Fasciola, Giardia, Leishmania, Loa loa, Naegleria, Schistosoma, Strongyloides, Taenia, Toxoplasma, Trichinella, Trypanosoma, Plasmodium*, and the like), a target nucleic acid can be an 18S rRNA.

In some cases, e.g., where the target nucleic acid is an antibiotic resistance gene, the target nucleic acid can be a gene involved in one or more of: i) aminoglycoside resistance (e.g., an aac (acetylase) gene; an aph (phosphorylation) gene; an ant (adenylation gene); ii) beta-lactam resistance, e.g., where the gene is a beta-lactamase gene, such as beta-lactamase class A, beta-lactamase class B, beta-lactamase class C, or beta-lactamase class D); iii) macrolide-lincosamide-streptogramin B ($MLS_B$) resistance (e.g., an erm rRNA methylase; an APT-binding transporter, a major facilitator family transporter, an esterase, a hydrolase, a transferase, or a phosphorylase); iv) a multidrug transporter (e.g., a major facilitator superfamily (MFS) transporter, an ATP-binding cassette transporter, an resistance-nodulation-cell divisional (RND) transporter, or a small multidrug resistance (SMR) transporter, v) tetracycline resistance (e.g., tetracycline efflux resistance or ribosome protection resistance); and vi) vancomycin resistance (e.g., VanA type operon, VanB type operon, VanC type operon, VanD type operon, VanE type operon, or VanG type operon).

In some cases, e.g., where the target nucleic acid is an antibiotic resistance gene, the target nucleic acid can be a gene involved aminoglycoside resistance. In some cases, e.g., where the target nucleic acid is an antibiotic resistance gene, the target nucleic acid can be an acetyltransferase gene (e.g., aac2I, aac2Ia, aac2Ib, etc.). In some cases, e.g., where the target nucleic acid is an antibiotic resistance gene, the target nucleic acid can be a nucleotidyltransferase (adenylyltransferase) (e.g., aadD ant2Ia, ant2Ib, ant3Ia, aad9, aad9Ib, etc.). In some cases, e.g., where the target nucleic acid is an antibiotic resistance gene, the target nucleic acid can be a phosphotransferase (e.g., aph33Ia, aph33Ib, aph3IIIa, aph3Iva, etc.).

In some cases, e.g., where the target nucleic acid is an antibiotic resistance gene, the target nucleic acid can be a gene involved in beta-lactam resistance. For example, the target nucleic acid is in some instances a beta-lactamase class A gene (e.g., BL2a_1, BL2a_III, BL2_len, BL2b_rob, BL2c_bro, BL2_kpc, etc. As another example, the target nucleic acid is in some instances a beta-lactamase class B gene (e.g., BL3_ccra, BL3_imp, BL3_sim, BL3_cit, BL3_vim, etc.). As another example, the target nucleic acid is in some instances a beta-lactamase class C gene (e.g., BL1_ampc, BL1-asba, BL1_cmy2, BL1_ec, BL1_pao, etc. As another example, the target nucleic acid is in some instances a beta-lactamase class D gene (e.g., BL2d_lcr1, BL2d_moxa, BL2d_oxa1, BL2d_r39, etc.).

In some cases, e.g., where the target nucleic acid is an antibiotic resistance gene, the target nucleic acid can be a gene involved in macrolide-lincosamide-streptogramin B ($MLS_B$) resistance. For example, the target nucleic acid is in some instances an erm class rRNA methylase (e.g., ermA, ermB, ermC, ermD, ermE, ermF, ermG, ermH, ermN, ermO, ermQ, ermS, ermT, etc.). As another example, the target nucleic acid is in some instances an ATP transporter gene (e.g., CarA, MsrA, OleB, SrmB, TlrC, VgaA, or VgaB). As another example, the target nucleic acid is in some instances a major facilitator superfamily transporter gene (e.g., LmrA, LmrB, or MefA). As another example, the target nucleic acid is in some instances an esterase gene (e.g., EreA or EreB). As another example, the target nucleic acid is in some instances a hydrolase gene (e.g., VgbA or VgbB). As another example, the target nucleic acid is in some instances a transferase gene (e.g., LnuA, LnuB, VatA, VatB, VatC, VatD, or VatE. As another example, the target nucleic acid is in some instances a phosphorylase gene (e.g., MphA, MphB, or MphC).

In some cases, e.g., where the target nucleic acid is an antibiotic resistance gene, the target nucleic acid can be a multidrug transporter gene. For example, the target nucleic acid is in some instances an ABC transporter gene (e.g., lsa). As another example, the target nucleic acid is in some instances a major facilitator superfamily transporter gene (e.g., Bmr, EmeA, EmrD, PmrA, RosA, cm1_e1, cm1_e2, etc.). As another example, the target nucleic acid is in some instances an RND transporter gene (e.g., AcrA, AcrB, AdeA, AdeB, AmrA, AmrB, CeoA, SmeA, SmeB, MexA, MexB, TolC, AdeC, OprA, OprM, etc.). As another example, the target nucleic acid is in some instances an SMR transporter gene (e.g., EmrE or Qac).

In some cases, e.g., where the target nucleic acid is an antibiotic resistance gene, the target nucleic acid can be a gene involved in tetracycline resistance. For example, the target nucleic acid is in some instances a tetracycline efflux protein gene (e.g., otrB, tcr3, tet30, tet31, tet33, tet39, tetA, tetB, tetC, tetD, tetE, tetG, tetH, tetJ, tetK, tetL, tetPA, tetV, tetY, tetZ, etc.). As another example, the target nucleic acid is in some instances a ribosomal protection protein against tetracycline gene (e.g., otrA, tet, tet32, tet36, tetM, tetO, tetPB, tetQ, tetS, tetT, or tetW).

In some cases, e.g., where the target nucleic acid is an antibiotic resistance gene, the target nucleic acid can be a gene involved in vancomycin resistance. For example, the target nucleic acid is in some instances a VanA operon gene (e.g., VanA, VanHA, VanRA, etc.). As another example, the target nucleic acid is in some instances a VanB operon gene (e.g., VanB, VanHB, VanRB, VanSB, etc.). As another example, the target nucleic acid is in some instances a VanC operon gene (e.g., VanC, VanRC, VanSC, VanT, or VanXYC). As another example, the target nucleic acid is in some instances a VanD operon gene (e.g., VanD, VanHD, VanRD, VanSD, VanXD, or VanYD). As another example, the target nucleic acid is in some instances a VanE operon gene (e.g., VanE, VanRE, VanSE, VanTE, or VanXYE). As another example, the target nucleic acid is in some instances a VanG operon gene (e.g., VanG, VanRG, VanSG, VanTG, VanUG, VanWG, VanXYG, or VanYG).

In some cases, e.g., where the target nucleic acid is an antibiotic resistance gene, the target nucleic acid can be a gene listed in FIG. 8. Non-limiting examples of such antibiotic resistance genes include $bla_{tem}$, $bla_{shv}$, $bla_{rob}$, $bla_{oxa}$, blaZ, aadB, aacC1, aacC2, aacC3, aac6'-IIa, aacA4, aad(6'), vanA, vanB, vanC, msrA, sarA, aac(6') aph(2''), vat, vga, ermA, ermB, ermC, int, sul, aac2ia, aac2ib, aac2ic, aac2id, aac2i, aac3ia, aac3iia, aac3iib, aac3iii, aac3iv, aac3ix, aac3vi, aac3viii, aac3vii, aac3x, aac6i, aac6ia, aac6ib, aac6ic, aac6ie, aac6if, aac6ig, aac6iia, aac6iib, aad9, aad9ib, aadd, acra, acrb, adea, adeb, adec, amra, amrb, ant2ia, ant2ib, ant3ia, ant4iia, ant6ia, aph33ia, aph33ib, aph3ia, aph3ib, aph3ic, aph3iiia, aph3iva, aph3va, aph3vb, aph3via, aph3viia, aph4ib, aph6ia, aph6ib, aph6ic, aph6id, arna, baca, bcra, bcrc, bl1_acc, bl1_ampc, bl1_asba, bl1_ceps, bl1_cmy2, bl1_ec, bl1_fox, bl1_mox, bl1_och, bl1_jao, bl1_pse, bl1_sm, bl2a_1, bl2a_exo, bl2a_iii2, bl2a_iii, bl2a_kcc, bl2a_nps, bl2a_okp, bl2a_jc, bl2be_ctxm, bl2be_oxy1, bl2be_per, bl2be_shv2, bl2b_rob, bl2b_tem, bl2b_tem2, bl2b_tem, bl2b_tle, bl2b_ula, bl2c_bro, bl2c_pse1, bl2c_pse3, bl2d_lcr1, bl2d_moxa, bl2d_oxa10, bl2d_oxa1, bl2d_oxa2, bl2d_oxa5, bl2d_oxa9, bl2d_r39, bl2e_cbla, bl2e_cepa, bl2e_cfxa, bl2e_fpm, bl2e_y56, bl2f_nmca, bl2f_smel, bl2_ges, bl2_kpc, bl2_len, bl2_veb, bl3_ccra, bl3_cit, bl3_cpha, bl3_gim, bl3_imp, bl3_1, bl3_shw, bl3_sim, bl3_vim, ble, blt, bmr, cara, cata10, cata11, cata12, cata13, cata14, cata15, cata16, cata1, cata2, cata3, cata4, cata5, cata6, cata7, cata8, cata9, catb 1, catb2, catb3, catb4, catb5, ceoa, ceob, cml_e1, cml_e2, cml_e3, cml_e4, cml_e5, cml_e6, cml_e7, cml_e8, dfra10, dfra12, dfra13, dfra14, dfra15, dfra16, dfra17, dfra19, dfra1, dfra20, dfra21, dfra22, dfra23, dfra24, dfra25, dfra25, dfra25, dfra26, dfra5, dfra7, dfrb1, dfrb2, dfrb3, dfrb6, emea, emrd, emre, erea, ereb, erma, ermb, ermc, ermd, erme, ermf, ermg, ermh, ermn, ermo, ermq, ermr, erms, ermt, ermu, ermv, ermw, ermx, ermy, fosa, fosb, fosc, fosx, fusb, fush, ksga, lmra, lmrb, lnua, inub, isa, maca, macb, mdte, mdtf, mdtg, mdth, mdtk, mdtl, mdtm, mdtn, mdto, mdtp, meca, mecrl, mefa, mepa, mexa, mexb, mexc, mexd, mexe, mexf, mexh, mexi, mexw, mexx, mexy, mfpa, mpha, mphb, mphc, msra, norm, oleb, opcm, opra, oprd, oprj, oprm, oprn, otra, otrb, pbp1a, pbp1b, pbp2b, pbp2, pbp2x, pmra, qac, qaca, qacb, qnra, qnrb, qnrs, rosa, rosb, smea, smeb, smec, smed, smee, smef, srmb, sta, str, sul1, sul2, sul3, tcma, tcr3, tet30, tet31, tet32, tet33, tet34, tet36, tet37, tet38, tet39, tet40, teta, tetb, tetc, tetd, tete, tetg, teth, tetj, tetk, tetd, tetm, teto, tetpa, tetpb, tet, tetq, tets, tett, tetu, tetv, tetw, text, tety, tetz, tlrc, tmrb, tolc, tsnr, vana, vanb, vanc, vand, vane, yang, vanha, vanhb, vanhd, vanra, vanrb, vanrc, vanrd, vanre, vanrg, vansa, vansb, vansc, vansd, vanse, vansg, vant, vante, vantg, vanug, vanwb, vanwg, vanxa, vanxb, vanxd, vanxyc, vanxye, vanxyg, vanya, vanyb, vanyd, vanyg, vanz, vata, vatb, vatc, vatd, vate, vgaa, vgab, vgba, vgbb, vph, ykkc, and ykkd (see the Antibiotic Resistance Genes Database (ARDB) available online). For example, in some cases, the target nucleic acid can be, e.g., mecA (e.g., as found in methicillin-resistant *Staphylococcus aureus* (MRSA)).

Samples

A sample includes a nucleic acid. As noted above, nucleic acids include: i) dsDNAs; ii) ssDNA, where a dsDNA can be prepared from a ssDNA, e.g., by second strand synthesis using the ssDNA as a template; and iii) RNA, where a dsDNA can be prepared from an RNA, e.g., by reverse transcription using the RNA as a template to generate a cDNA, and second strand synthesis using the cDNA as a template. For simplicity, the discussion below refers to "DNA" or "DNAs"; however, the nucleic acid being detected can be a dsDNA that is prepared from a ssDNA (such as a ssDNA virus) or from an RNA (such as an RNA virus).

A subject sample includes nucleic acid (e.g., a plurality of nucleic acids). The term "plurality" is used herein to mean two or more. In some cases, a sample includes two or more (e.g., 3 or more, 5 or more, 10 or more, 20 or more, 50 or more, 100 or more, 500 or more, 1,000 or more, or 5,000 or more) nucleic acids (e.g., dsDNAs; or in the case of a ssDNA, a dsDNA prepared from a ssDNA, e.g., by second strand synthesis using the ssDNA as a template; or in the case of an RNA, a dsDNA prepared from an RNA, e.g., by reverse transcription using the RNA as a template to generate a cDNA, and second strand synthesis using the cDNA as a template). In some cases, the sample includes 5 or more DNAs (e.g., 10 or more, 20 or more, 50 or more, 100 or more, 500 or more, 1,000 or more, or 5,000 or more DNAs) that differ from one another in sequence. In some cases, the sample includes 10 or more, 20 or more, 50 or more, 100 or more, 500 or more, $10^3$ or more, $5 \times 10^3$ or more, $10^4$ or more, $5 \times 10^4$ or more, $10^5$ or more, $5 \times 10^5$ or more, $10^6$ or more $5 \times 10^6$ or more, or $10^7$ or more, DNAs. In some cases, the sample comprises from 10 to 20, from 20 to 50, from 50 to 100, from 100 to 500, from 500 to $10^3$, from $10^3$ to $5 \times 10^3$, from $5 \times 10^3$ to $10^4$, from $10^5$ to $5 \times 10^4$, from $5 \times 10^4$ to $10^5$, from $10^5$ to $5 \times 10^5$, from $5 \times 10^5$ to $10^6$, from $10^6$ to $5 \times 10^6$, or from $5 \times 10^6$ to $10^7$, or more than $10^7$, DNAs. In some cases, the sample comprises from 5 to $10^7$ DNAs (e.g., that differ from one another in sequence) e.g., from 5 to $10^6$, from 5 to $10^5$, from 5 to 50,000, from 5 to 30,000, from 10 to $10^6$, from 10 to $10^5$, from 10 to 50,000, from 10 to 30,000, from 20 to $10^6$, from 20 to $10^5$, from 20 to 50,000, or from 20 to 30,000 DNAs). In some cases, the sample includes 20 or more DNAs that differ from one another in sequence. In some cases, the sample includes DNAs from a cell lysate (e.g., a eukaryotic cell lysate, a mammalian cell lysate, a human cell lysate, a prokaryotic cell lysate, a plant cell lysate, and the like). For example, in some cases, the sample includes DNA from a cell such as a eukaryotic cell, e.g., a mammalian cell such as a human cell.

The term "sample" is used herein to mean any sample that includes DNA (e.g., in order to determine whether a target DNA is present among a population of DNAs). As noted above, nucleic acids include dsDNAs; or in the case of a ssDNA, a dsDNA prepared from a ssDNA, e.g., by second strand synthesis using the ssDNA as a template; or in the case of an RNA, a dsDNA prepared from an RNA, e.g., by reverse transcription using the RNA as a template to generate a cDNA, and second strand synthesis using the cDNA as a template. The sample can be derived from any source, e.g., the sample can be a synthetic combination of purified DNAs; the sample can be a cell lysate, a DNA-enriched cell lysate, or DNAs isolated and/or purified from a cell lysate. The sample can be from a patient (e.g., for the purpose of diagnosis). The sample can be from permeabilized cells. The sample can be from crosslinked cells. The sample can be in tissue sections. The sample can be from tissues prepared by crosslinking followed by delipidation and adjustment to make a uniform refractive index. Examples of tissue preparation by crosslinking followed by delipidation and adjustment to make a uniform refractive index have been described in, for example, Shah et al., Development (2016) 143, 2862-2867 doi:10.1242/dev.138560.

A "sample" can include a target DNA and a plurality of non-target DNAs. In some cases, the target DNA is present in the sample at one copy per 10 non-target DNAs, one copy per 20 non-target DNAs, one copy per 25 non-target DNAs, one copy per 50 non-target DNAs, one copy per 100 non-target DNAs, one copy per 500 non-target DNAs, one copy per $10^3$ non-target DNAs, one copy per $5\times10^3$ non-target DNAs, one copy per $10^4$ non-target DNAs, one copy per $5\times10^4$ non-target DNAs, one copy per $10^5$ non-target DNAs, one copy per $5\times10^5$ non-target DNAs, one copy per $10^6$ non-target DNAs, or less than one copy per $10^6$ non-target DNAs. In some cases, the target DNA is present in the sample at from one copy per 10 non-target DNAs to 1 copy per 20 non-target DNAs, from 1 copy per 20 non-target DNAs to 1 copy per 50 non-target DNAs, from 1 copy per 50 non-target DNAs to 1 copy per 100 non-target DNAs, from 1 copy per 100 non-target DNAs to 1 copy per 500 non-target DNAs, from 1 copy per 500 non-target DNAs to 1 copy per $10^3$ non-target DNAs, from 1 copy per $10^3$ non-target DNAs to 1 copy per $5\times10^3$ non-target DNAs, from 1 copy per $5\times10^3$ non-target DNAs to 1 copy per $10^4$ non-target DNAs, from 1 copy per $10^4$ non-target DNAs to 1 copy per $10^5$ non-target DNAs, from 1 copy per $10^5$ non-target DNAs to 1 copy per $10^6$ non-target DNAs, or from 1 copy per $10^6$ non-target DNAs to 1 copy per $10^7$ non-target DNAs.

Suitable samples include, but are not limited to, saliva, blood, serum, plasma, urine, aspirate, and biopsy samples. Thus, the term "sample" with respect to a patient encompasses blood and other liquid samples of biological origin, solid tissue samples such as a biopsy specimen or tissue cultures or cells derived therefrom and the progeny thereof. The definition also includes samples that have been manipulated in any way after their procurement, such as by treatment with reagents; washed; or enrichment for certain cell populations, such as cancer cells. The definition also includes sample that have been enriched for particular types of molecules, e.g., DNAs. The term "sample" encompasses biological samples such as a clinical sample such as blood, plasma, serum, aspirate, cerebrospinal fluid (CSF), a bronchoalveolar lavage sample, or sputum; and also includes tissue obtained by surgical resection, tissue obtained by biopsy, cells in culture, cell supernatants, cell lysates, tissue samples, organs, bone marrow, and the like. A "biological sample" includes biological fluids derived therefrom (e.g., cancerous cell, infected cell, etc.), e.g., a sample comprising DNAs that is obtained from such cells (e.g., a cell lysate or other cell extract comprising DNAs).

A sample can comprise, or can be obtained from, any of a variety of cells, tissues, organs, or acellular fluids. Suitable sample sources include eukaryotic cells, bacterial cells, and archaeal cells. Suitable sample sources include single-celled organisms and multi-cellular organisms. Suitable sample sources include single-cell eukaryotic organisms; a plant or a plant cell; an algal cell, e.g., *Botryococcus braunii, Chlamydomonas reinhardtii, Nannochloropsis gaditana, Chlorella pyrenoidosa, Sargassum patens, C. agardh*, and the like; a fungal cell (e.g., a yeast cell); an animal cell, tissue, or organ; a cell, tissue, or organ from an invertebrate animal (e.g. fruit fly, cnidarian, echinoderm, nematode, an insect, an arachnid, etc.); a cell, tissue, fluid, or organ from a vertebrate animal (e.g., fish, amphibian, reptile, bird, mammal); a cell, tissue, fluid, or organ from a mammal (e.g., a human; a non-human primate; an ungulate; a feline; a bovine; an ovine; a caprine; etc.). Suitable sample sources include nematodes, protozoans, and the like. Suitable sample sources include parasites such as helminths, malarial parasites, etc.

Suitable sample sources include a cell, tissue, or organism of any of the six kingdoms, e.g., Bacteria (e.g., Eubacteria); Archaebacteria; Protista; Fungi; Plantae; and Animalia. Suitable sample sources include plant-like members of the kingdom Protista, including, but not limited to, algae (e.g., green algae, red algae, glaucophytes, cyanobacteria); fungus-like members of Protista, e.g., slime molds, water molds, etc.; animal-like members of Protista, e.g., flagellates (e.g., *Euglena*), amoeboids (e.g., amoeba), sporozoans (e.g, Apicomplexa, Myxozoa, Microsporidia), and ciliates (e.g., *Paramecium*). Suitable sample sources include include members of the kingdom Fungi, including, but not limited to, members of any of the phyla: Basidiomycota (club fungi; e.g., members of *Agaricus, Amanita, Boletus, Cantherellus*, etc.); Ascomycota (sac fungi, including, e.g., *Saccharomyces*); Mycophycophyta (lichens); Zygomycota (conjugation fungi); and Deuteromycota. Suitable sample sources include members of the kingdom Plantae, including, but not limited to, members of any of the following divisions: Bryophyta (e.g., mosses), Anthocerotophyta (e.g., hornworts), Hepaticophyta (e.g., liverworts), Lycophyta (e.g., club mosses), Sphenophyta (e.g., horsetails), Psilophyta (e.g., whisk ferns), Ophioglossophyta, Pterophyta (e.g., ferns), Cycadophyta, Gingkophyta, Pinophyta, Gnetophyta, and Magnoliophyta (e.g., flowering plants). Suitable sample sources include members of the kingdom Animalia, including, but not limited to, members of any of the following phyla: Porifera (sponges); Placozoa; Orthonectida (parasites of marine invertebrates); Rhombozoa; Cnidaria (corals, anemones, jellyfish, sea pens, sea pansies, sea wasps); Ctenophora (comb jellies); Platyhelminthes (flatworms); Nemertina (ribbon worms); Ngathostomulida (jawed worms)p Gastrotricha; Rotifera; Priapulida; Kinorhyncha; Loricifera; *Acanthocephala*; Entoprocta; Nemotoda; Nematomorpha; Cycliophora; Mollusca (mollusks); Sipuncula (peanut worms); Annelida (segmented worms); Tardigrada (water bears); Onychophora (velvet worms); Arthropoda (including the subphyla: Chelicerata, Myriapoda, Hexapoda, and Crustacea, where the Chelicerata include, e.g., arachnids, Merostomata, and Pycnogonida, where the Myriapoda include, e.g., Chilopoda (centipedes), Diplopoda (millipedes), Paropoda, and Symphyla, where the Hexapoda include insects, and where the Crustacea include shrimp, krill, barnacles, etc.; Phoronida; Ectoprocta (moss animals); Brachiopoda; Echinodermata (e.g. starfish, sea daisies, feather stars, sea urchins, sea cucumbers, brittle stars, brittle baskets, etc.); Chaetognatha (arrow worms); Hemichordata (acorn worms); and Chordata. Suitable members of Chordata include any member of the following subphyla: Urochordata (sea squirts; including Ascidiacea, Thaliacea, and Larvacea); Cephalochordata (lancelets); Myxini (hagfish);

and Vertebrata, where members of Vertebrata include, e.g., members of Petromyzontida (lampreys), Chondrichthyces (cartilaginous fish), Actinopterygii (ray-finned fish), Actinista (coelocanths), Dipnoi (lungfish), Reptilia (reptiles, e.g., snakes, alligators, crocodiles, lizards, etc.), Aves (birds); and Mammalian (mammals). Suitable plants include any monocotyledon and any dicotyledon.

Suitable sources of a sample include cells, fluid, tissue, or organ taken from an organism; from a particular cell or group of cells isolated from an organism; etc. For example, where the organism is a plant, suitable sources include xylem, the phloem, the cambium layer, leaves, roots, etc. Where the organism is an animal, suitable sources include particular tissues (e.g., lung, liver, heart, kidney, brain, spleen, skin, fetal tissue, etc.), or a particular cell type (e.g., neuronal cells, epithelial cells, endothelial cells, astrocytes, hepatocytes, cardiac cells, macrophages, glial cells, islet cells, T lymphocytes, B lymphocytes, etc.).

In some cases, the source of the sample is a (or is suspected of being a diseased cell, fluid, tissue, or organ. In some cases, the source of the sample is a normal (non-diseased) cell, fluid, tissue, or organ. In some cases, the source of the sample is a (or is suspected of being a pathogen-infected cell, tissue, or organ. For example, the source of a sample can be an individual who may or may not be infected—and the sample could be any biological sample (e.g., blood, saliva, biopsy, plasma, serum, bronchoalveolar lavage, sputum, a fecal sample, cerebrospinal fluid, a fine needle aspirate, a swab sample (e.g., a buccal swab, a cervical swab, a nasal swab), interstitial fluid, synovial fluid, nasal discharge, tears, buffy coat, a mucous membrane sample, an epithelial cell sample (e.g., epithelial cell scraping), etc.) collected from the individual. In some cases, the sample is a cell-free liquid sample. In some cases, the sample is a liquid sample that can comprise cells.

Pathogens include viruses, fungi, helminths, protozoa, malarial parasites, *Plasmodium* parasites, *Toxoplasma* parasites, *Schistosoma* parasites, and the like. "Helminths" include roundworms, heartworms, and phytophagous nematodes (Nematoda), flukes (Tematoda), *Acanthocephala*, and tapeworms (Cestoda). Protozoan infections include infections from *Giardia* spp., *Trichomonas* spp., African trypanosomiasis, amoebic dysentery, babesiosis, balantidial dysentery, Chaga's disease, coccidiosis, malaria and toxoplasmosis. Examples of pathogens such as parasitic/protozoan pathogens include, but are not limited to: *Plasmodium falciparum, Plasmodium vivax, Trypanosoma cruzi* and *Toxoplasma gondin*. Fungal pathogens include, but are not limited to: *Cryptococcus neoformans, Histoplasma capsulatum, Coccidioides immitis, Blastomyces dermatitidis, Chlamydia trachomatis*, and *Candida albicans*. Pathogenic viruses include, e.g., immunodeficiency virus (e.g., HIV); influenza virus; dengue; West Nile virus; herpes virus; yellow fever virus; Hepatitis Virus C; Hepatitis Virus A; Hepatitis Virus B; papillomavirus; and the like. Pathogenic viruses can include DNA viruses such as: a papovavirus (e.g., human papillomavirus (HPV), polyomavirus); a hepadnavirus (e.g., Hepatitis B Virus (HBV)); a herpesvirus (e.g., herpes simplex virus (HSV), varicella zoster virus (VZV), epstein-barr virus (EBV), cytomegalovirus (CMV), herpes lymphotropic virus, *Pityriasis Rosea*, kaposi's sarcoma-associated herpesvirus); an adenovirus (e.g., atadenovirus, aviadenovirus, ichtadenovirus, mastadenovirus, siadenovirus); a poxvirus (e.g., smallpox, vaccinia virus, cowpox virus, monkeypox virus, orf virus, pseudocowpox, bovine papular stomatitis virus; tanapox virus, yaba monkey tumor virus; molluscum contagiosum virus (MCV)); a parvovirus (e.g., adeno-associated virus (AAV), Parvovirus B19, human bocavirus, bufavirus, human parv4 GI); Geminiviridae; Nanoviridae; Phycodnaviridae; and the like. Pathogens can include, e.g., DNAviruses [e.g.: a papovavirus (e.g., human papillomavirus (HPV), polyomavirus); a hepadnavirus (e.g., Hepatitis B Virus (HBV)); a herpesvirus (e.g., herpes simplex virus (HSV), varicella zoster virus (VZV), Epstein-Barr virus (EBV), cytomegalovirus (CMV), herpes lymphotropic virus, *Pityriasis rosea*, Kaposi's sarcoma-associated herpesvirus); an adenovirus (e.g., atadenovirus, aviadenovirus, ichtadenovirus, mastadenovirus, siadenovirus); a poxvirus (e.g., smallpox, vaccinia virus, cowpox virus, monkeypox virus, orf virus, pseudocowpox, bovine papular stomatitis virus; tanapox virus, yaba monkey tumor virus; molluscum contagiosum virus (MCV)); a parvovirus (e.g., adeno-associated virus (AAV), Parvovirus B19, human bocavirus, bufavirus, human parv4 GI); Geminiviridae; Nanoviridae; Phycodnaviridae; and the like], *Mycobacterium tuberculosis, Streptococcus agalactiae*, methicillin-resistant *Staphylococcus aureus, Legionella pneumophila, Streptococcus pyogenes, Escherichia coli, Neisseria gonorrhoeae, Neisseria meningitidis*, Pneumococcus, *Cryptococcus neoformans, Histoplasma capsulatum, Hemophilus influenzae* B, *Treponema pallidum*, Lyme disease spirochetes, *Pseudomonas aeruginosa, Mycobacterium leprae, Brucella abortus*, rabies virus, influenza virus, cytomegalovirus, herpes simplex virus I, herpes simplex virus II, human serum parvo-like virus, respiratory syncytial virus, varicella-zoster virus, hepatitis B virus, hepatitis C virus, measles virus, adenovirus, human T-cell leukemia viruses, Epstein-Barr virus, murine leukemia virus, mumps virus, vesicular stomatitis virus, Sindbis virus, lymphocytic choriomeningitis virus, wart virus, blue tongue virus, Sendai virus, feline leukemia virus, Reovirus, polio virus, simian virus 40, mouse mammary tumor virus, dengue virus, rubella virus, West Nile virus, *Plasmodium falciparum, Plasmodium vivax, Toxoplasma gondii, Trypanosoma rangeli, Trypanosoma cruzi, Trypanosoma rhodesiense, Trypanosoma brucei, Schistosoma mansoni, Schistosoma japonicum, Babesia bovis, Eimeria tenella, Onchocerca volvulus, Leishmania tropica, Mycobacterium tuberculosis, Trichinella spiralis, Theileria parva, Taenia hydatigena, Taenia ovis, Taenia saginata, Echinococcus granulosus, Mesocestoides corti, Mycoplasma arthritidis, M. hyorhinis, M. orale, M. arginini, Acholeplasma laidlawii, M. salivarium*, and *M. pneumoniae*.

Detection

In some cases, a method of the present disclosure comprises detecting a target DNA in a sample. Type V CRISPR/Cas proteins, e.g., Cas12 proteins such as Cpf1 (Cas12a) and C2c1 (Cas12b) can promiscuously cleave non-targeted single stranded DNA (ssDNA) once activated by detection of a target DNA (double or single stranded). Once a type V CRISPR/Cas effector protein (e.g., a Cas12 protein such as Cas12a, Cas12b, Cas12c, Cas12d, Cas12e) is activated by a guide RNA, which occurs when the guide RNA hybridizes to a target sequence of a target DNA (i.e., the sample includes the targeted DNA), the protein becomes a nuclease that promiscuously cleaves ssDNAs (i.e., the nuclease cleaves non-target ssDNAs, i.e., ssDNAs to which the guide sequence of the guide RNA does not hybridize). Thus, when the target DNA is present in the sample (e.g., in some cases above a threshold amount), the result is cleavage of ssDNAs in the sample, which can be detected using any convenient detection method (e.g., using a labeled single stranded detector DNA).

Provided are compositions and methods for detecting a target DNA (double stranded or single stranded) in a sample. In some cases, a detector DNA is used that is single stranded (ssDNA) and does not hybridize with the guide sequence of the guide RNA (i.e., the detector ssDNA is a non-target ssDNA). Such methods can include (a) contacting the sample with: (i) a type V CRISPR/Cas effector protein (e.g., a Cas12 protein); (ii) a guide RNA comprising: a region that binds to the type V CRISPR/Cas effector protein, and a guide sequence that hybridizes with the target DNA; and (iii) a detector DNA that is single stranded and does not hybridize with the guide sequence of the guide RNA; and (b) measuring a detectable signal produced by cleavage of the single stranded detector DNA by the type V CRISPR/Cas effector protein, thereby detecting the target DNA. As noted above, once a subject Type V CRISPR/Cas effector protein (e.g., a Cas12 protein such as Cas12a, Cas12b, Cas12c, Cas12d, Cas12e) is activated by a guide RNA, which occurs when the sample includes a target DNA to which the guide RNA hybridizes (i.e., the sample includes the targeted target DNA), the Type V CRISPR/Cas effector protein (e.g., a Cas12 protein such as Cas12a, Cas12b, Cas12c, Cas12d, Cas12e) is activated and functions as an endoribonuclease that non-specifically cleaves ssDNAs (including non-target ssDNAs) present in the sample. Thus, when the targeted target DNA is present in the sample (e.g., in some cases above a threshold amount), the result is cleavage of ssDNA (including non-target ssDNA) in the sample, which can be detected using any convenient detection method (e.g., using a labeled detector ssDNA).

Also provided are compositions and methods for cleaving single stranded DNAs (ssDNAs) (e.g., non-target ssDNAs). Such methods can include contacting a population of nucleic acids, wherein said population comprises a target DNA and a plurality of non-target ssDNAs, with: (i) a type V CRISPR/Cas effector protein; and (ii) a guide RNA comprising: a region that binds to the type V CRISPR/Cas effector protein, and a guide sequence that hybridizes with the target DNA, wherein the type V CRISPR/Cas effector protein cleaves non-target ssDNAs of said plurality. Such a method can be used, e.g., to cleave foreign ssDNAs (e.g., viral DNAs) in a cell.

The contacting step of a subject method can be carried out in a composition comprising divalent metal ions. The contacting step can be carried out in an acellular environment, e.g., outside of a cell. The contacting step can be carried out inside a cell. The contacting step can be carried out in a cell in vitro. The contacting step can be carried out in a cell ex vivo. The contacting step can be carried out in a cell in vivo.

The guide RNA can be provided as RNA or as a nucleic acid encoding the guide RNA (e.g., a DNA such as a recombinant expression vector). The Type V CRISPR/Cas effector protein (e.g., a Cas12 protein such as Cas12a, Cas12b, Cas12c, Cas12d, Cas12e) can be provided as a protein or as a nucleic acid encoding the protein (e.g., an mRNA, a DNA such as a recombinant expression vector). In some cases, two or more (e.g., 3 or more, 4 or more, 5 or more, or 6 or more) guide RNAs can be provided by (e.g., using a precursor guide RNA array, which can be cleaved by the Type V CRISPR/Cas effector protein into individual ("mature") guide RNAs).

In some cases (e.g., when contacting with a guide RNA and a Type V CRISPR/Cas effector protein (e.g., a Cas12 protein such as Cas12a, Cas12b, Cas12c, Cas12d, Cas12e)), the sample is contacted for 2 hours or less (e.g., 1.5 hours or less, 1 hour or less, 40 minutes or less, 30 minutes or less, 20 minutes or less, 10 minutes or less, or 5 minutes or less, or 1 minute or less) prior to the measuring step. For example, In some cases, the sample is contacted for 40 minutes or less prior to the measuring step. In some cases, the sample is contacted for 20 minutes or less prior to the measuring step. In some cases, the sample is contacted for 10 minutes or less prior to the measuring step. In some cases, the sample is contacted for 5 minutes or less prior to the measuring step. In some cases, the sample is contacted for 1 minute or less prior to the measuring step. In some cases, the sample is contacted for from 50 seconds to 60 seconds prior to the measuring step. In some cases, the sample is contacted for from 40 seconds to 50 seconds prior to the measuring step. In some cases, the sample is contacted for from 30 seconds to 40 seconds prior to the measuring step. In some cases, the sample is contacted for from 20 seconds to 30 seconds prior to the measuring step. In some cases, the sample is contacted for from 10 seconds to 20 seconds prior to the measuring step.

A method of the present disclosure for detecting a target DNA (single-stranded or double-stranded) in a sample can detect a target DNA with a high degree of sensitivity. In some cases, a method of the present disclosure can be used to detect a target DNA present in a sample comprising a plurality of DNAs (including the target DNA and a plurality of non-target DNAs), where the target DNA is present at one or more copies per $10^7$ non-target DNAs (e.g., one or more copies per $10^6$ non-target DNAs, one or more copies per $10^5$ non-target DNAs, one or more copies per $10^4$ non-target DNAs, one or more copies per $10^3$ non-target DNAs, one or more copies per $10^2$ non-target DNAs, one or more copies per 50 non-target DNAs, one or more copies per 20 non-target DNAs, one or more copies per 10 non-target DNAs, or one or more copies per 5 non-target DNAs). In some cases, a method of the present disclosure can be used to detect a target DNA present in a sample comprising a plurality of DNAs (including the target DNA and a plurality of non-target DNAs), where the target DNA is present at one or more copies per $10^{18}$ non-target DNAs (e.g., one or more copies per $10^{15}$ non-target DNAs, one or more copies per $10^{12}$ non-target DNAs, one or more copies per $10^9$ non-target DNAs, one or more copies per $10^6$ non-target DNAs, one or more copies per $10^5$ non-target DNAs, one or more copies per $10^4$ non-target DNAs, one or more copies per $10^3$ non-target DNAs, one or more copies per $10^2$ non-target DNAs, one or more copies per 50 non-target DNAs, one or more copies per 20 non-target DNAs, one or more copies per 10 non-target DNAs, or one or more copies per 5 non-target DNAs).

In some cases, a method of the present disclosure can detect a target DNA present in a sample, where the target DNA is present at from one copy per $10^7$ non-target DNAs to one copy per 10 non-target DNAs (e.g., from 1 copy per $10^7$ non-target DNAs to 1 copy per $10^2$ non-target DNAs, from 1 copy per $10^7$ non-target DNAs to 1 copy per $10^3$ non-target DNAs, from 1 copy per $10^7$ non-target DNAs to 1 copy per $10^4$ non-target DNAs, from 1 copy per $10^7$ non-target DNAs to 1 copy per $10^5$ non-target DNAs, from 1 copy per $10^7$ non-target DNAs to 1 copy per $10^6$ non-target DNAs, from 1 copy per $10^5$ non-target DNAs to 1 copy per 10 non-target DNAs, from 1 copy per $10^6$ non-target DNAs to 1 copy per $10^2$ non-target DNAs, from 1 copy per $10^6$ non-target DNAs to 1 copy per $10^3$ non-target DNAs, from 1 copy per $10^6$ non-target DNAs to 1 copy per $10^4$ non-target DNAs, from 1 copy per $10^6$ non-target DNAs to 1 copy per $10^5$ non-target DNAs, from 1 copy per $10^5$ non-target DNAs to 1 copy per 10 non-target DNAs, from 1 copy per $10^5$ non-target DNAs to 1 copy per $10^2$ non-target DNAs, from 1 copy per $10^5$ non-target DNAs to 1 copy per $10^3$ non-target DNAs, or from 1 copy per $10^5$ non-target DNAs to 1 copy per $10^4$ non-target DNAs).

In some cases, a method of the present disclosure can detect a target DNA present in a sample, where the target DNA is present at from one copy per $10^{18}$ non-target DNAs to one copy per 10 non-target DNAs (e.g., from 1 copy per $10^{18}$ non-target DNAs to 1 copy per $10^2$ non-target DNAs, from 1 copy per $10^{15}$ non-target DNAs to 1 copy per $10^2$ non-target DNAs, from 1 copy per $10^{12}$ non-target DNAs to 1 copy per $10^2$ non-target DNAs, from 1 copy per $10^9$ non-target DNAs to 1 copy per $10^2$ non-target DNAs, from 1 copy per $10^7$ non-target DNAs to 1 copy per $10^2$ non-target DNAs, from 1 copy per $10^7$ non-target DNAs to 1 copy per $10^3$ non-target DNAs, from 1 copy per $10^7$ non-target DNAs to 1 copy per $10^4$ non-target DNAs, from 1 copy per $10^7$ non-target DNAs to 1 copy per $10^5$ non-target DNAs, from 1 copy per $10^7$ non-target DNAs to 1 copy per $10^6$ non-target DNAs, from 1 copy per $10^6$ non-target DNAs to 1 copy per 10 non-target DNAs, from 1 copy per $10^6$ non-target DNAs to 1 copy per $10^2$ non-target DNAs, from 1 copy per $10^6$ non-target DNAs to 1 copy per $10^3$ non-target DNAs, from 1 copy per $10^6$ non-target DNAs to 1 copy per $10^4$ non-target DNAs, from 1 copy per $10^6$ non-target DNAs to 1 copy per $10^5$ non-target DNAs, from 1 copy per $10^5$ non-target DNAs to 1 copy per 10 non-target DNAs, from 1 copy per $10^5$ non-target DNAs to 1 copy per $10^2$ non-target DNAs, from 1 copy per $10^5$ non-target DNAs to 1 copy per $10^3$ non-target DNAs, or from 1 copy per $10^5$ non-target DNAs to 1 copy per $10^4$ non-target DNAs).

In some cases, a method of the present disclosure can detect a target DNA present in a sample, where the target DNA is present at from one copy per $10^7$ non-target DNAs to one copy per 100 non-target DNAs (e.g., from 1 copy per $10^7$ non-target DNAs to 1 copy per $10^2$ non-target DNAs, from 1 copy per $10^7$ non-target DNAs to 1 copy per $10^3$ non-target DNAs, from 1 copy per $10^7$ non-target DNAs to 1 copy per $10^4$ non-target DNAs, from 1 copy per $10^7$ non-target DNAs to 1 copy per $10^5$ non-target DNAs, from 1 copy per $10^7$ non-target DNAs to 1 copy per $10^6$ non-target DNAs, from 1 copy per $10^5$ non-target DNAs to 1 copy per 100 non-target DNAs, from 1 copy per $10^6$ non-target DNAs to 1 copy per $10^2$ non-target DNAs, from 1 copy per $10^6$ non-target DNAs to 1 copy per $10^3$ non-target DNAs, from 1 copy per $10^6$ non-target DNAs to 1 copy per $10^4$ non-target DNAs, from 1 copy per $10^6$ non-target DNAs to 1 copy per $10^5$ non-target DNAs, from 1 copy per $10^5$ non-target DNAs to 1 copy per 100 non-target DNAs, from 1 copy per $10^5$ non-target DNAs to 1 copy per $10^2$ non-target DNAs, from 1 copy per $10^5$ non-target DNAs to 1 copy per $10^3$ non-target DNAs, or from 1 copy per $10^5$ non-target DNAs to 1 copy per $10^4$ non-target DNAs).

In some cases, the threshold of detection, for a subject method of detecting a target DNA in a sample, is 10 nM or less. The term "threshold of detection" is used herein to describe the minimal amount of target DNA that must be present in a sample in order for detection to occur. Thus, as an illustrative example, when a threshold of detection is 10 nM, then a signal can be detected when a target DNA is present in the sample at a concentration of 10 nM or more. In some cases, a method of the present disclosure has a threshold of detection of 5 nM or less. In some cases, a method of the present disclosure has a threshold of detection of 1 nM or less. In some cases, a method of the present disclosure has a threshold of detection of 0.5 nM or less. In some cases, a method of the present disclosure has a threshold of detection of 0.1 nM or less. In some cases, a method of the present disclosure has a threshold of detection of 0.05 nM or less. In some cases, a method of the present disclosure has a threshold of detection of 0.01 nM or less. In some cases, a method of the present disclosure has a threshold of detection of 0.005 nM or less. In some cases, a method of the present disclosure has a threshold of detection of 0.001 nM or less. In some cases, a method of the present disclosure has a threshold of detection of 0.0005 nM or less. In some cases, a method of the present disclosure has a threshold of detection of 0.0001 nM or less. In some cases, a method of the present disclosure has a threshold of detection of 0.00005 nM or less. In some cases, a method of the present disclosure has a threshold of detection of 0.00001 nM or less. In some cases, a method of the present disclosure has a threshold of detection of 10 pM or less. In some cases, a method of the present disclosure has a threshold of detection of 1 pM or less. In some cases, a method of the present disclosure has a threshold of detection of 500 fM or less. In some cases, a method of the present disclosure has a threshold of detection of 250 fM or less. In some cases, a method of the present disclosure has a threshold of detection of 100 fM or less. In some cases, a method of the present disclosure has a threshold of detection of 50 fM or less. In some cases, a method of the present disclosure has a threshold of detection of 500 aM (attomolar) or less. In some cases, a method of the present disclosure has a threshold of detection of 250 aM or less. In some cases, a method of the present disclosure has a threshold of detection of 100 aM or less. In some cases, a method of the present disclosure has a threshold of detection of 50 aM or less. In some cases, a method of the present disclosure has a threshold of detection of 10 aM or less. In some cases, a method of the present disclosure has a threshold of detection of 1 aM or less.

In some cases, the threshold of detection (for detecting the target DNA in a subject method), is in a range of from 500 fM to 1 nM (e.g., from 500 fM to 500 pM, from 500 fM to 200 pM, from 500 fM to 100 pM, from 500 fM to 10 pM, from 500 fM to 1 pM, from 800 fM to 1 nM, from 800 fM to 500 pM, from 800 fM to 200 pM, from 800 fM to 100 pM, from 800 fM to 10 pM, from 800 fM to 1 pM, from 1 pM to 1 nM, from 1 pM to 500 pM, from 1 pM to 200 pM, from 1 pM to 100 pM, or from 1 pM to 10 pM) (where the concentration refers to the threshold concentration of target DNA at which the target DNA can be detected). In some cases, a method of the present disclosure has a threshold of detection in a range of from 800 fM to 100 pM. In some cases, a method of the present disclosure has a threshold of detection in a range of from 1 pM to 10 pM. In some cases, a method of the present disclosure has a threshold of detection in a range of from 10 fM to 500 fM, e.g., from 10 fM to 50 fM, from 50 fM to 100 fM, from 100 fM to 250 fM, or from 250 fM to 500 fM.

In some cases, the minimum concentration at which a target DNA can be detected in a sample is in a range of from 500 fM to 1 nM (e.g., from 500 fM to 500 pM, from 500 fM to 200 pM, from 500 fM to 100 pM, from 500 fM to 10 pM, from 500 fM to 1 pM, from 800 fM to 1 nM, from 800 fM to 500 pM, from 800 fM to 200 pM, from 800 fM to 100 pM, from 800 fM to 10 pM, from 800 fM to 1 pM, from 1 pM to 1 nM, from 1 pM to 500 pM, from 1 pM to 200 pM, from 1 pM to 100 pM, or from 1 pM to 10 pM). In some cases, the minimum concentration at which a target DNA can be detected in a sample is in a range of from 800 fM to 100 pM. In some cases, the minimum concentration at which a target DNA can be detected in a sample is in a range of from 1 pM to 10 pM.

In some cases, the threshold of detection (for detecting the target DNA in a subject method), is in a range of from 1 aM to 1 nM (e.g., from 1 aM to 500 pM, from 1 aM to 200 pM, from 1 aM to 100 pM, from 1 aM to 10 pM, from 1 aM to 1 pM, from 100 aM to 1 nM, from 100 aM to 500 pM, from 100 aM to 200 pM, from 100 aM to 100 pM, from 100 aM to 10 pM, from 100 aM to 1 pM, from 250 aM to 1 nM, from 250 aM to 500 pM, from 250 aM to 200 pM, from 250 aM to 100 pM, from 250 aM to 10 pM, from 250 aM to 1 pM, from 500 aM to 1 nM, from 500 aM to 500 pM, from 500 aM to 200 pM, from 500 aM to 100 pM, from 500 aM to 10 pM, from 500 aM to 1 pM, from 750 aM to 1 nM, from 750 aM to 500 pM, from 750 aM to 200 pM, from 750 aM to 100 pM, from 750 aM to 10 pM, from 750 aM to 1 pM, from 1 fM to 1 nM, from 1 fM to 500 pM, from 1 fM to 200 pM, from 1 fM to 100 pM, from 1 fM to 10 pM, from 1 fM to 1 pM, from 500 fM to 500 pM, from 500 fM to 200 pM, from 500 fM to 100 pM, from 500 fM to 10 pM, from 500 fM to 1 pM, from 800 fM to 1 nM, from 800 fM to 500 pM, from 800 fM to 200 pM, from 800 fM to 100 pM, from 800 fM to 10 pM, from 800 fM to 1 pM, from 1 pM to 1 nM, from 1 pM to 500 pM, from 1 pM to 200 pM, from 1 pM to 100 pM, or from 1 pM to 10 pM) (where the concentration refers to the threshold concentration of target DNA at which the target DNA can be detected). In some cases, a method of the present disclosure has a threshold of detection in a range of from 1 aM to 800 aM. In some cases, a method of the present disclosure has a threshold of detection in a range of from 50 aM to 1 pM. In some cases, a method of the present disclosure has a threshold of detection in a range of from 50 aM to 500 fM.

In some cases, the minimum concentration at which a target DNA can be detected in a sample is in a range of from 1 aM to 1 nM (e.g., from 1 aM to 500 pM, from 1 aM to 200 pM, from 1 aM to 100 pM, from 1 aM to 10 pM, from 1 aM to 1 pM, from 100 aM to 1 nM, from 100 aM to 500 pM, from 100 aM to 200 pM, from 100 aM to 100 pM, from 100 aM to 10 pM, from 100 aM to 1 pM, from 250 aM to 1 nM, from 250 aM to 500 pM, from 250 aM to 200 pM, from 250 aM to 100 pM, from 250 aM to 10 pM, from 250 aM to 1 pM, from 500 aM to 1 nM, from 500 aM to 500 pM, from 500 aM to 200 pM, from 500 aM to 100 pM, from 500 aM to 10 pM, from 500 aM to 1 pM, from 750 aM to 1 nM, from 750 aM to 500 pM, from 750 aM to 200 pM, from 750 aM to 100 pM, from 750 aM to 10 pM, from 750 aM to 1 pM, from 1 fM to 1 nM, from 1 fM to 500 pM, from 1 fM to 200 pM, from 1 fM to 100 pM, from 1 fM to 10 pM, from 1 fM to 1 pM, from 500 fM to 500 pM, from 500 fM to 200 pM, from 500 fM to 100 pM, from 500 fM to 10 pM, from 500 fM to 1 pM, from 800 fM to 1 nM, from 800 fM to 500 pM, from 800 fM to 200 pM, from 800 fM to 100 pM, from 800 fM to 10 pM, from 800 fM to 1 pM, from 1 pM to 1 nM, from 1 pM to 500 pM, from 1 pM to 200 pM, from 1 pM to 100 pM, or from 1 pM to 10 pM). In some cases, the minimum concentration at which a target DNA can be detected in a sample is in a range of from 1 aM to 500 pM. In some cases, the minimum concentration at which a target DNA can be detected in a sample is in a range of from 100 aM to 500 pM.

In some cases, a subject composition or method exhibits an attomolar (aM) sensitivity of detection. In some cases, a subject composition or method exhibits a femtomolar (fM) sensitivity of detection. In some cases, a subject composition or method exhibits a picomolar (pM) sensitivity of detection. In some cases, a subject composition or method exhibits a nanomolar (nM) sensitivity of detection.

Kits

The present disclosure provides a kit for carrying out a method of the present disclosure (e.g., a method of characterizing a target DNA present in a sample).

In some cases, a kit of the present disclosure comprises:
A) a type V CRISPR/Cas effector protein;
B) one or more guide RNAs, where the one or more guide RNAs comprise: i) a region that binds to the type V CRISPR/Cas effector protein; and ii) a guide sequence that hybridizes with the target DNA; and
C) a double-stranded nucleic acid adapter, where the adapter comprises a 5' overhang that comprises a stretch of from 3 to 15 contiguous nucleotides that are complementary to a contiguous stretch of nucleotides of the same length in the 5' overhang of a PAM-distal cleavage product generated by action of the type V CRISPR/Cas effector protein and the one or more guide RNAs on the target DNA.

In some cases, the kit also includes one or more reagents for determining the nucleotide sequence of a ligation product formed by ligating the adapter and the PAM-distal cleavage product.

In some cases, the kit also includes one or more reagents for amplifying the target DNA. For example, in some cases, the kit comprises one or more sets of primer pairs.

In some cases, one or more components of a kit of the present disclosure is lyophilized.

Examples of Non-Limiting Aspects of the Disclosure

Aspects, including embodiments, of the present subject matter described above may be beneficial alone or in combination, with one or more other aspects or embodiments. Without limiting the foregoing description, certain non-limiting aspects of the disclosure numbered 1-48 are provided below. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

Aspect 1. A method for characterizing a target DNA present in a sample, the method comprising:
A) contacting the sample with:
(a) a type V CRISPR/Cas effector protein; and
(b) one or more guide RNAs, wherein the one or more guide RNAs comprise: i) a region that binds to the type V CRISPR/Cas effector protein; and ii) a guide sequence that hybridizes with the target DNA, wherein said contacting generates a protospacer adjacent motif (PAM)-distal cleavage product comprising a 5' overhang;
B) ligating a double-stranded nucleic acid adapter to the cleavage product, wherein the adapter comprises a 5' overhang that comprises a stretch of from 3 to 15 contiguous nucleotides that are complementary to a contiguous stretch of nucleotides of the same length in the 5' overhang of the PAM-distal cleavage product, wherein said ligating generates a ligation product comprising the adapter and the PAM-distal cleavage product; and
C) determining the nucleotide sequence of the PAM-distal cleavage product present in the ligation product.

Aspect 2. The method of aspect 1, wherein the type V CRISPR/Cas effector protein is a Cas12 protein.

Aspect 3. The method of aspect 1, wherein the type V CRISPR/Cas effector protein is a Cas12a (Cpf1) protein.

Aspect 4. The method of aspect 1, wherein the type V CRISPR/Cas effector protein is a Cas12b (C2c1) protein.

Aspect 5. The method of aspect 1, wherein the type V CRISPR/Cas effector protein is a Cas12d protein.

Aspect 6. The method of aspect 1, wherein the type V CRISPR/Cas effector protein is a Cas14a protein.

Aspect 7. The method of any one of aspects 1-6, wherein the target DNA is single stranded.

Aspect 8. The method of any one of aspects 1-6, wherein the target DNA is double stranded.

Aspect 9. The method of any one of aspects 1-8, wherein the target DNA is viral DNA.

Aspect 10. The method of aspect 9, wherein the target DNA is papovavirus, hepadnavirus, herpesvirus, adenovirus, poxvirus, or parvovirus DNA.

Aspect 11. The method of any one of aspects 1-8, wherein the target DNA is bacterial DNA.

Aspect 12. The method of any one of aspects 1-8, wherein the target DNA is tick-borne pathogen DNA.

Aspect 13. The method of any one of aspects 1-8, wherein the target DNA is multiple drug resistant bacterial DNA.

Aspect 14. The method of any one of aspects 1-8, wherein the target DNA is DNA of a eukaryotic pathogen.

Aspect 15. The method of aspect 14, wherein the eukaryotic pathogen is a pathogenic protozoan, a pathogenic fungus, or a pathogenic helminth.

Aspect 16. The method of aspect 14, wherein the pathogenic protozoan is a *Plasmodium* spp., a *Trypanosoma* spp., a *Trichomonas* spp., an amoeba, a *Giardia* spp., or a *Toxoplama* spp.

Aspect 17. The method of aspect 15, wherein the pathogenic fungus is an *Aspergillus* spp., a *Candida* spp., an *Epidermophyton* spp., a *Histoplasma* spp., or a *Trichphtyon* spp.

Aspect 18. The method of aspect 15, wherein the pathogenic helminth is a nematode or a platyhelminth.

Aspect 19. The method of aspect 18, wherein the pathogenic helminth is an *Ascaris* spp., an *Echinococcus* spp., a *Schistosoma* spp., a *Strongyloides* spp., a *Taenia* spp., or a *Trichinella* spp.

Aspect 20. The method of any one of aspects 1-8, wherein the target DNA is fetal DNA.

Aspect 21. The method of any one of aspects 1-20, comprising contacting the sample with 2 or more guide RNAs, wherein the 2 or more guide RNAs differ from one another in the guide sequence.

Aspect 22. The method of aspect 21, comprising contacting the sample with from 2 to 10 guide RNAs.

Aspect 23. The method of any one of aspects 1-22, wherein the sample comprises a cell.

Aspect 24. The method of any one of aspects 1-22, wherein the sample is a cell lysate.

Aspect 25. The method of any one of aspects 1-22, wherein the sample is a cell-free sample.

Aspect 26. The method of any one of aspects 1-22, wherein the sample is blood, serum, plasma, bronchoalveolar lavage, sputum, urine, cerebrospinal fluid, feces, or a biopsy sample.

Aspect 27. The method of any one of aspects 1-26, comprising amplifying the target DNA prior to said contacting step.

Aspect 28. The method of aspect 27, wherein said amplifying comprises contacting the sample with 2 or more sets of primer pairs.

Aspect 29. The method of aspect 28, wherein the 2 or more sets of primer pairs provides for amplification of DNA of a plurality of different pathogens.

Aspect 30. The method of aspect 27, wherein said amplifying comprises isothermal amplification.

Aspect 31. The method of any one of aspects 27-30, wherein said amplification comprises contacting the sample with 1 or more pairs of forward and reverse primers, wherein the 1 or more pairs of forward and reverse primers are selected from the forward and reverse primers depicted in any one of SEQ ID Nos: 71 to 6432.

Aspect 32. The method of any one of aspects 27-30, wherein said amplification comprises contacting the sample with 1 or more pairs of forward and reverse primers, wherein the 1 or more pairs of forward and reverse primers are selected from the forward and reverse primers depicted in any one of SEQ ID Nos: 6433 to 13607.

Aspect 33. The method of any one of aspects 27-30, wherein said amplification comprises contacting the sample with 1 or more pairs of forward and reverse primers, wherein the 1 or more pairs of forward and reverse primers are selected from the forward and reverse primers depicted in SEQ ID Nos:13608 to 17378.

Aspect 34. The method of aspect 1, wherein the adapter comprises a 3' deoxyadenosine overhang.

Aspect 35. The method of any one of aspects 1-34, wherein sequence determination is carried out by nanopore sequencing.

Aspect 36. The method of any one of aspects 1-34, wherein the target DNA is present in the sample at a concentration as low as 200 fM.

Aspect 37. The method of any one of aspects 1-36, further comprising contacting the sample with a detector DNA that is single stranded and does not hybridize with the guide sequence of the guide RNA; and measuring a detectable signal produced by cleavage of the single stranded detector DNA by the type V CRISPR/Cas effector protein, thereby detecting the target DNA Aspect 38. The method of aspect 37, wherein the single stranded detector DNA comprises a fluorescence-emitting dye pair.

Aspect 39. The method of aspect 38, wherein the fluorescence-emitting dye pair is a fluorescence resonance energy transfer (FRET) pair.

Aspect 40. The method of aspect 39, wherein the fluorescence-emitting dye pair is a quencher/fluor pair.

Aspect 41. The method of any one of aspects 1-40, wherein the single stranded detector DNA comprises a modified nucleobase, a modified sugar moiety, and/or a modified nucleic acid linkage.

Aspect 42. A kit for characterizing a target DNA present in a sample, the system comprising:

A) a type V CRISPR/Cas effector protein;

B) one or more guide RNAs, wherein the one or more guide RNAs comprise: i) a region that binds to the type V CRISPR/Cas effector protein; and ii) a guide sequence that hybridizes with the target DNA; and C) a double-stranded nucleic acid adapter, wherein the adapter comprises a 5' overhang that comprises a stretch of from 3 to 15 contiguous nucleotides that are complementary to a contiguous stretch of nucleotides of the same length in the 5' overhang of protospacer adjacent motif (PAM)-distal cleavage product generated by action of the type V CRISPR/Cas effector protein and the one or more guide RNAs on the target DNA.

Aspect 43. The kit of aspect 42, further comprising one or more reagents for determining the nucleotide sequence of a ligation product formed by ligating the adapter and the PAM-distal cleavage product.

Aspect 44. The kit of aspect 42 or 43, further comprising one or more reagents for amplifying the target DNA.

Aspect 45. The kit of aspect 44, comprising one or more sets of primer pairs.

Aspect 46. The kit of aspect 45, wherein the one or more pairs of forward and reverse primers are selected from the forward and reverse primers depicted in any one of SEQ ID Nos: 71 to 6432.

Aspect 47. The kit of aspect 45, wherein the one or more pairs of forward and reverse primers are selected from the forward and reverse primers depicted in any one of SEQ ID Nos: 6433 to 13607.

Aspect 48. The kit of aspect 45, wherein the one or more pairs of forward and reverse primers are selected from the forward and reverse primers depicted in SEQ ID Nos:13608 to 17378.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or see, second(s); min, minute(s); h or hr, hour(s); aa, amino acid(s); kb, kilobase(s); bp, base pair(s); nt, nucleotide(s); i.m., intramuscular(ly); i.p., intraperitoneal (ly); s.c., subcutaneous(ly); and the like.

Example 1

Primers for detecting antibiotic resistant bacteria (e.g., detecting antibiotic resistance genes) were designed as follows:

1) Start with the 11,376 gene references (unique accession numbers) in the ARDB database; 2) Use CD-HIT to narrow the references down to 1,079 gene references (each with <95% identity to each other); 3) Design primers using automated algorithm (600 bp fragment size, 300 bp overlap, 50 nt selection window); 4) Remove primers with Tm>2 SD, homopolymeric; 5) Remove any reverse primers that overlap with forward primers.

Figure 9A:
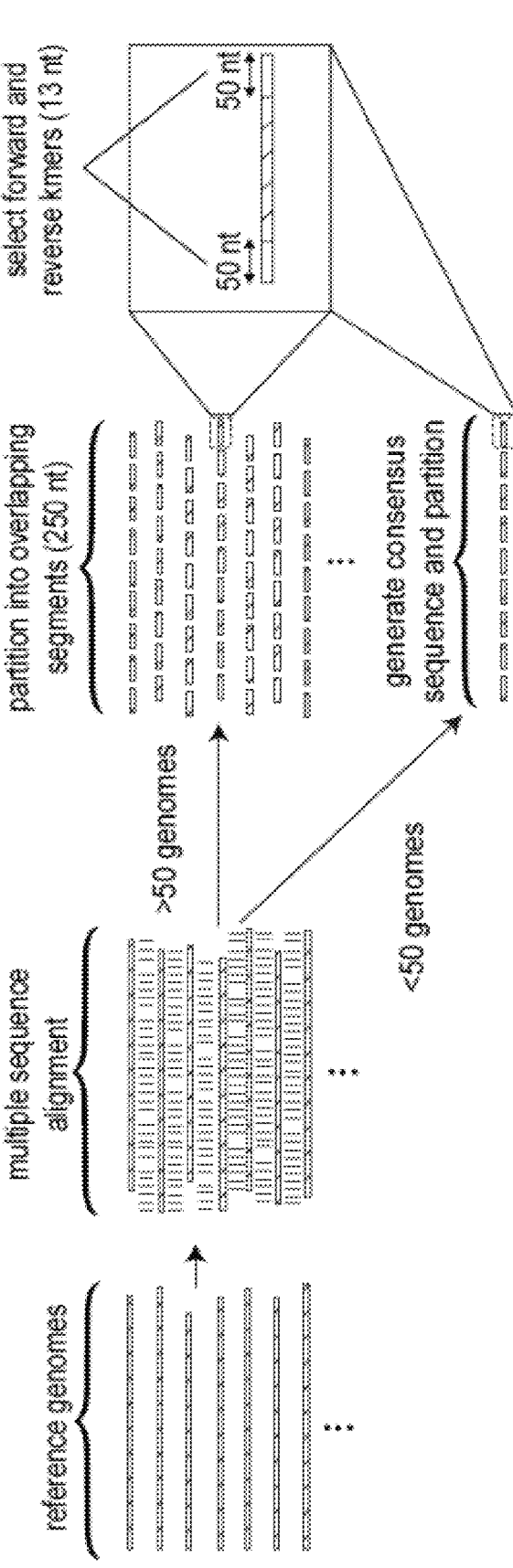
FIG. 9A-9B provides a schematic depiction of a method of designing primers suitable for amplifying target nucleic acids encoding antibiotic resistance factors.
Figure 9B:
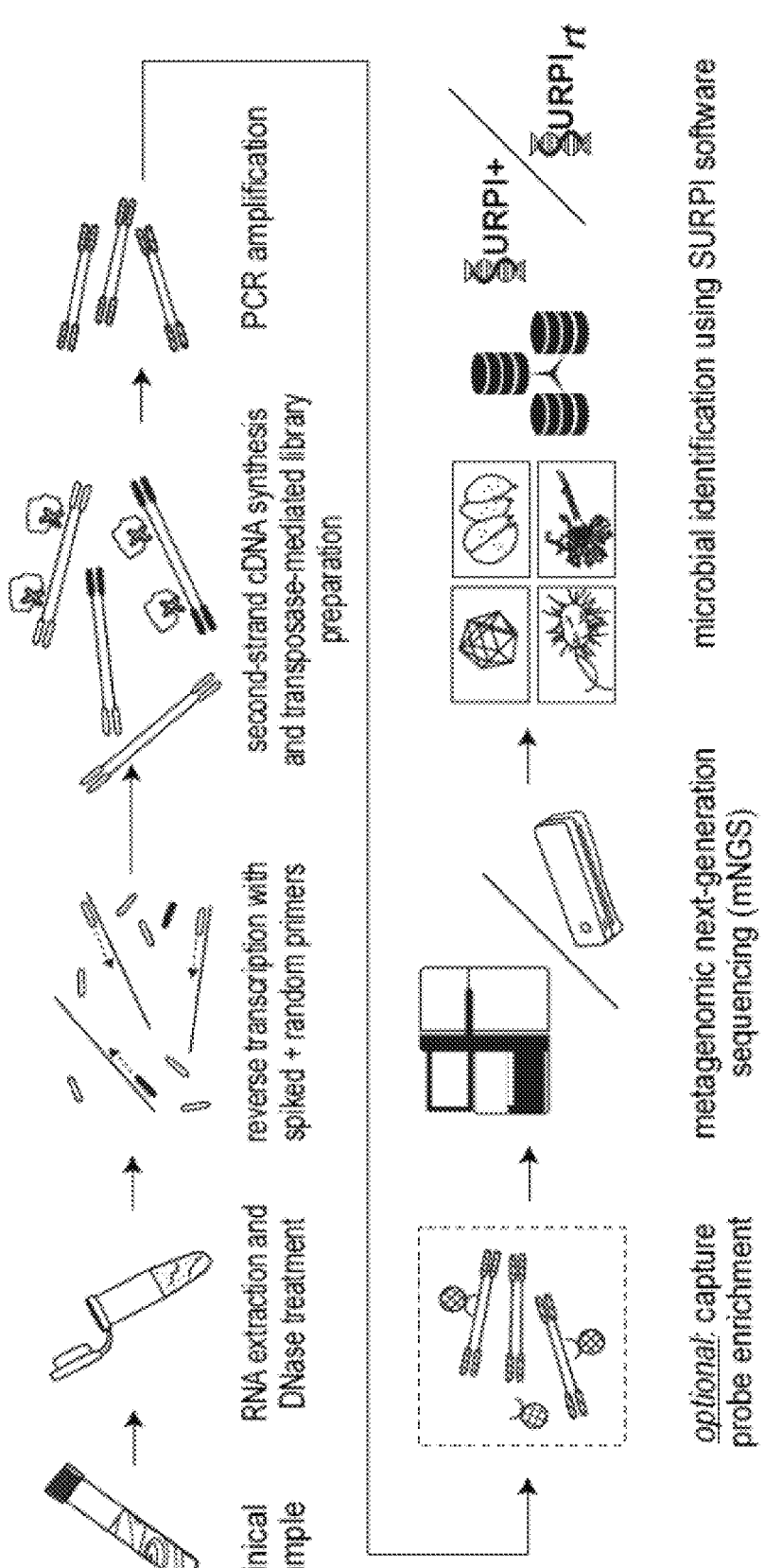

This method is depicted schematically in FIG. 9A-9B.

The genes that were targeted are denoted as follows: (position highlighted in bold, with the corresponding position in the bacterial genome in bold and italics): >gi|108796981|ref|NC008146l|_gi|108797245|ref|YP_637442.1|_aac2i_305541_306162.

Example 2: Metagenomic Sequencing with Spiked Primer Enrichment (MSSPE)

Clinical Sample Collection

Viral cultures of ZIKV (Uganda strain), DENV (type 1), and MS2 bacteriophage were purchased from American Type Culture Collection (ATCC, Manassas VA, USA). Ebola cultures Kikwit strain in TRIzol LS (Thermo Fisher Scientific, Waltham, MA, USA) was used. Clinical ZIKV serum samples were collected by Central Laboratory of Epidemiology (CLE), IMSS in Mexico City, Mexico. Real-time quantitative reverse transcription PCR (RT-PCR) testing was used for ZIKV detection and viral titer determination by standard curve analysis (Lanciotti et al. (2008) *Emerg Infect Dis* 14:1232; Sardi et al. (2016) *J Clin Microbiol* 54:2348). Forward and reverse primers (ZIKV 1086 and ZIKV 1162c, respectively) and Carboxyfluorescein (FAM)-labelled probes (ZIKV 1107-FAM) were used as previously described (Lanciotti et al. (2008) supra). Clinical Ebola samples collected from patients in the 2014 Boende and 2018 North Kivu province outbreaks were used. Clinical HIV and hepatitis C plasma samples were obtained from the UCSF Clinical Microbiology Laboratory (San Francisco, USA). The CSF sample from a patient with POWV meningoencephalitis was provided by Boston Children's Hospital. The CSF sample from a patient from SLEV meningoencephalitis was provided by University of California, Los Angeles (UCLA) Medical Center (Chiu et al. (2017) *Emerg Infect Dis* 23:1694). Negative plasma sample matrix used as a "no template" control (NTC) was obtained from Golden West Biologicals Inc. (Temecula, CA, USA).

MSSPE Viral Spiked Primer Design

Multiple sequence alignment (MSA) of viral genomes (downloaded from NCBI GenBank as of September 2017) was performed using MAFFT at default parameters (algorithm="Auto", scoring matrix="200 PAM/k=2", gap open penalty=1.53, offset value=0.123) (Katoh et al. (2014) *Methods Mol Biol* 1079:131-146). An in-house bioinformatics pipeline named "MSSPE-design" was developed on an Ubuntu Linux computational server for automated design of spiked primers. Briefly, the MSA-aligned genomes were partitioned into overlapping 500 nucleotide (nt) segments with 250 nt overlap using PYFASTA (http://pypi.python.org/pypi/pyfasta/). Forward or reverse 13 nt primers were selected from 50 nt regions at the ends of each segment by iteratively ranking candidate 13mer ("kmer") sequences in reverse order by frequency, selecting the top kmer shared by the most segments and not containing any ambiguous nucleotides, and then removing segments sharing that 13mer before repeating the process on the remaining segments. To decrease overall spiked primer costs, the iterations were repeated until the number of remaining segments containing a shared kmer was below a pre-designated threshold (ranging from n=1 for viruses with only a limited number of genomes/genome segments such as CCHF to n=10 for viruses comprising thousands of genomes and multiple genotypes such as DENV). Spiked primers were filtered by removal of primers with melting temperatures (Tm) greater than 2 standard deviations from the mean or that were predicted to self-dimerize or cross-dimerize with a ΔG value of −9 kcals/mol or more negative.

Spiked primers were ordered and synthesized by Integrated DNA Technologies Inc. (IDT, Coralville, Iowa, USA). Forward or reverse spiked primer oligonucleotides targeting individual viruses were synthesized on a 10 nmole scale in 96-well plates with standard desalting and 6 nm of each individual oligonucleotide were mixed and then resuspended to a final volume of 500 μL in IDTE pH 8.0. Spiked primer panels (ArboV, HFV, and AHV) were designed by mixing the spiked primers for each individual virus in equimolar ratios and then diluting with TE (Tris-EDTA) buffer to the desired concentration.

Construction of Metagenomic Sequencing Libraries

Viral RNA was extracted from 200 μL of contrived or clinical patient samples using the EZ1 Advanced XL BioRobot and EZ1 Virus Mini Kit (Qiagen, Redwood City, CA), with the exception of EBOV RNA, which was extracted manually in the viral hemorrhagic fever reference laboratory in INRB, Kinshasa using the Direct-zol RNA MiniPrep Kit (Zymo Research, Irvine, CA). 25 μL of nucleic acid extract was treated with DNase (3 μL Turbo DNase, 1 μL Baseline, 5 μL Turbo buffer and 16 μL nuclease-free water), and incubated on an Eppendorf ThermoMixer at 37° C., 600 rpm for 30 min. The Zymo RNA Clean and Concentrator kit (Zymo Research, Irvine, CA) was used to clean up DNase-treated RNA, and the final RNA was eluted in 32 μL water. The RNA was then mixed with random hexamer (RH) alone (1 μM) or spiked primer plus RH in a 10:1 ratio of spiked primer to RH, and heated to 65° C. for 5 min. The reverse transcription master mix (10 μL SuperScript III buffer, L dNTP of 12.5 mM, 2.5 μL DTT of 0.1M, 1 μL SuperScript III enzyme) was added to each sample and incubated at 25° C. for 5 min, followed by 42° C. for 30 min and 94° C. for 2 min. After cooling to 10° C., a second-strand synthesis master mix (3.7 μL Sequenase buffer, 0.225 μL Sequenase enzyme and 1.1 μL water) was added to each reaction, followed by a slow 2 min ramp to 37° C. and 8 min incubation. The resulting cDNA was cleaned up using the Zymo DNA Clean and Concentrator kit (Zymo Research, Irvine, CA), with the addition of 10 μL linear acrylamide to each sample, and eluted in 10 μL water. Using the Illumina Nextera XT kit, 2.5 μL sample cDNA was incubated at 55° C. for 5 mins in tagmentation mix (10 μL TD buffer and 5 μL ATM enzyme), and immediately neutralized with 2.5 μL NT buffer. 12.5 μL of tagmented DNA was then transferred to reaction tube containing indexing mix (7.5 μL Nextera XT NPM, 2.5 μL N-7xx primer and 2.5 μL S-5xx primer), followed by PCR amplification (72° C. for 3 min, 95° C. for 30 s, followed by 16 cycles of denaturation (95° C. for 10 s), annealing (55° C. for 30 s), and extension (72° C. for 30 s), with a final extension at 72° C. for 5 min). After PCR, 3 μL of PCR product was analyzed by 2% gel electrophoresis to check for library size and band intensity. If no band or only a very faint band was observed on the gel, another round of recovery PCR was performed. For recovery PCR, the library was washed using 0.9×AMPure XT beads (Beckman Coulter, Carlsb ad, CA, USA) and 5 μL clean library was mixed with 45 μL master mix (10 μL buffer, 2.5 μL of 10 uM Nextera general primers (forward 5'AATGATACGGCGAC-CACCGA3' (SEQ ID NO:17), reverse 5'CAAGCAGAA-GACGGCATACG3' (SEQ ID NO:18)), 1 μL dNTP, 0.5 μL Phusion DNA polymerase enzyme and 31 μL water), followed by a 95° C. incubation for 30 s and 10 cycles of PCR (95° C. for 30 s denaturation, 60° C. for 30 s annealing, and 72° C. for 30 s extension), with a final extension at 72° C. for 5 min. The final cDNA library was eluted in 20 μL EB buffer after a wash step using 0.9×AMPure beads.

Metagenomic Sequencing

The cDNA libraries were quantified using the Qubit fluorometer (Thermo Fisher Scientific) and the sizes of the libraries were measured using Agilent Bioanalyzer (Agilent Technologies, Santa Clara, CA). Illumina sequencing was performed on a MiSeq instrument using 150 nt single-end runs according to the manufacturer's protocol. For nanopore, amplified cDNA libraries from Nextera library preparation were end-repaired and ligated with adapter and motor proteins using the 1D Ligation Sequencing Kit (Oxford Nanopore Technologies). Metagenomic libraries for nanopore sequencing were run on R9.4 or R9.5 flow cells, using either a MinION MK1B or GridION X5 instrument (Oxford Nanopore Technologies).

Capture Probe Enrichment for ZIKV Samples

The xGen Lockdown Kit (IDT Technologies, Redwood City, CA) was used for capture probe enrichment of ZIKV. Briefly, barcoded amplified cDNA libraries corresponding to each sample were mixed in equimolar proportions to generate a 500 ng pooled library. The pooled library was then added to a hybridization mix containing ZIKV xGen Lockdown probes, and the hybridization reaction was performed by incubation at 65° C. for 16 h, followed by streptavidin bead capture for 45 min. Beads containing captured cDNA were re-suspended in an amplification reaction mix (25 μL KAPA HiFi HotStart ReadyMix, 1.25 μL xGen primer and 3.75 μL water), and post-capture PCR was performed (98° C. for 45 s, followed by 10 cycles of denaturing (98° C. for 15 s), annealing (60° C. for 30 s), and extension (72° C. for 30 s), with a final extension at 72° C. for 1 min). PCR amplicons were purified using 1.5× volume of AMPure XP beads and finally eluted in 20 μL EB buffer. Purified PCR products were analyzed by 2% gel electrophoresis to check library size, and DNA concentration was estimated using the Qubit fluorometer. The capture probe enriched library was run on an Illumina MiSeq instrument using 150 nt single-end runs according to the manufacturer's protocol.

Tiling Multiplex PCR Enrichment for ZIKV

Tiling multiplex PCR for ZIKV enrichment was performed according to the "Primal" protocol described by Quick et. al (2017) Nat Protoc 12:1261, except for libraries prepared using both MSSPE and tiling multiplex PCR, for which an AMPure bead wash of 1.2× was performed immediately after cDNA synthesis (before adding multiplexed primers) to remove residual ZIKV MSSPE primers (4 M) that had been added during the reverse transcription step. After visualization of a PCR band of the expected size (400 nt) by 2% gel electrophoresis, barcoded sequencing libraries were prepared using the NEBNext Ultra II DNA Library Preparation Kit (New England BioLabs, Inc., Ipswich, MA), and sequenced on an Illumina MiSeq instrument using 250 nt paired-end runs according to the manufacturer's protocol.

Bioinformatics Pipelines for Viral Detection and Reference Genome Alignment

Sequencing data from Illumina MiSeq or HiSeq instruments were analyzed for viruses using the SURPI+ ("sequence based ultra-rapid pathogen identification") computational pipeline (UCSF), a modified version of a previously published bioinformatics analysis pipeline for pathogen identification from mNGS sequence data (Naccache et al. (2014) Genome Res 24:1180). Specifically, the SURPI+ pipeline modifications include (i) updated reference databases based on the NCBI nt database (March 2015 build), (ii) a filtering algorithm for exclusion of false-positive hits from database misannotations, and (iii) taxonomic classification for species-level identification. Viral reads were mapped to reference genome and percent coverage determined an in-house developed SURPIviz graphical visualization interface or Geneious software v10 (Kearse et al. (2012) Bioinformatics 28:1647). For virus detection from nanopore reads, an in-house developed pipeline called SURPIrt (SURPI "real-time", unpublished), which identifies viral reads by Bowtie2 alignment (Langmead, 2012 #47) to the NCBI Viral RefSeq database or the viral portion of the NCBI nt database, was used. Viral reads obtained by nanopore sequencing were mapped to reference genomes using GraphMap (Sovic et al. (2016) Nat Commun 7:11307).

Quantification and Statistical Analysis

The RPM (reads per million) metric was calculated as the number of viral species-specific reads divided by the number of preprocessed reads (reads remaining after adapter trimming, low-quality filtering, and low-complexity filtering of raw reads) for Illumina sequencing, or the number of viral species-specific reads divided by the number of base called reads for nanopore sequencing. The fold change for MSSPE enrichment was defined as the RPM obtained for a target virus using MSSPE divided by the RPM obtained using RH priming only. The median fold change is given instead of the mean fold change if the data contained outliers. The percent increase in genome coverage is the genome coverage obtained using RH alone subtracted from that obtained using MSSPE. Chi-squared test was used to compare two proportions, and p value less than 0.05 is considered statistically significant.

Results

A general method was developed for viral enrichment and genome recovery from clinical samples for use in diagnostics, public health surveillance, and outbreak investigation. The method is (i) applicable for any targeted virus, regardless of its degree of representation in reference databases (e.g. from 60 to 3,571 reference genomes/genome segments) (FIG. 10A), (ii) preserves broad metagenomic sensitivity for comprehensive detection of known and novel pathogens (viral and non-viral) and co-infections, (iii) does not affect overall turnaround times for sample processing, and (iv) enriches mNGS libraries sufficiently to allow robust viral genome recovery from low-titer clinical samples. An automated computational algorithm was designed that took as input an arbitrary set of reference genomes and constructed a minimal panel of short, 13-nt spiked primers covering these genomes (FIG. 10A), to be added during the cDNA synthesis (reverse transcription step of mNGS library preparation (FIG. 10B). Spiked primers were designed for 14 viruses, in total comprising 6,102 primers and including vector-borne and/or hemorrhagic fever viruses of public health significance.

Figure 10A:
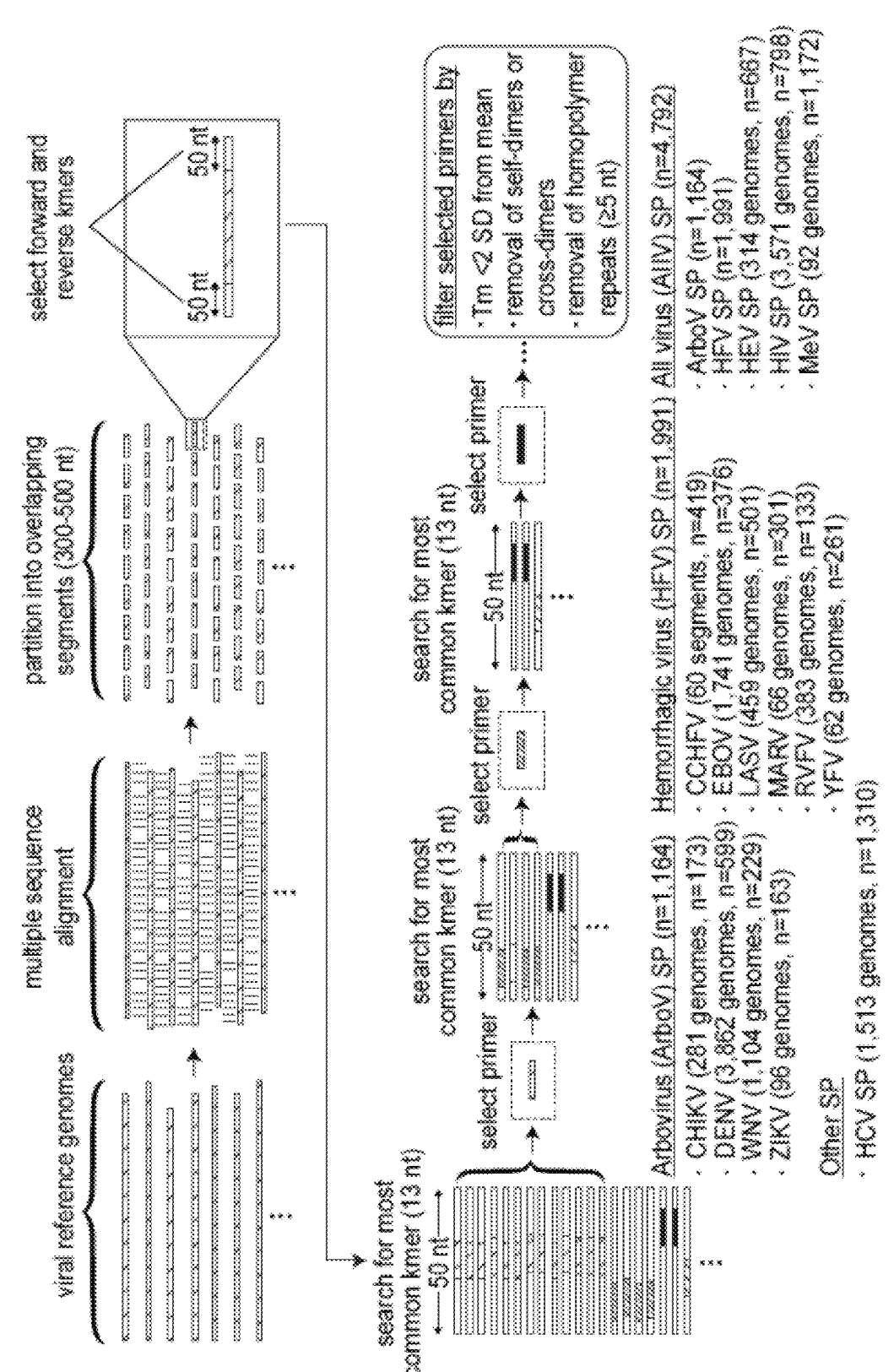
Figure 10B:
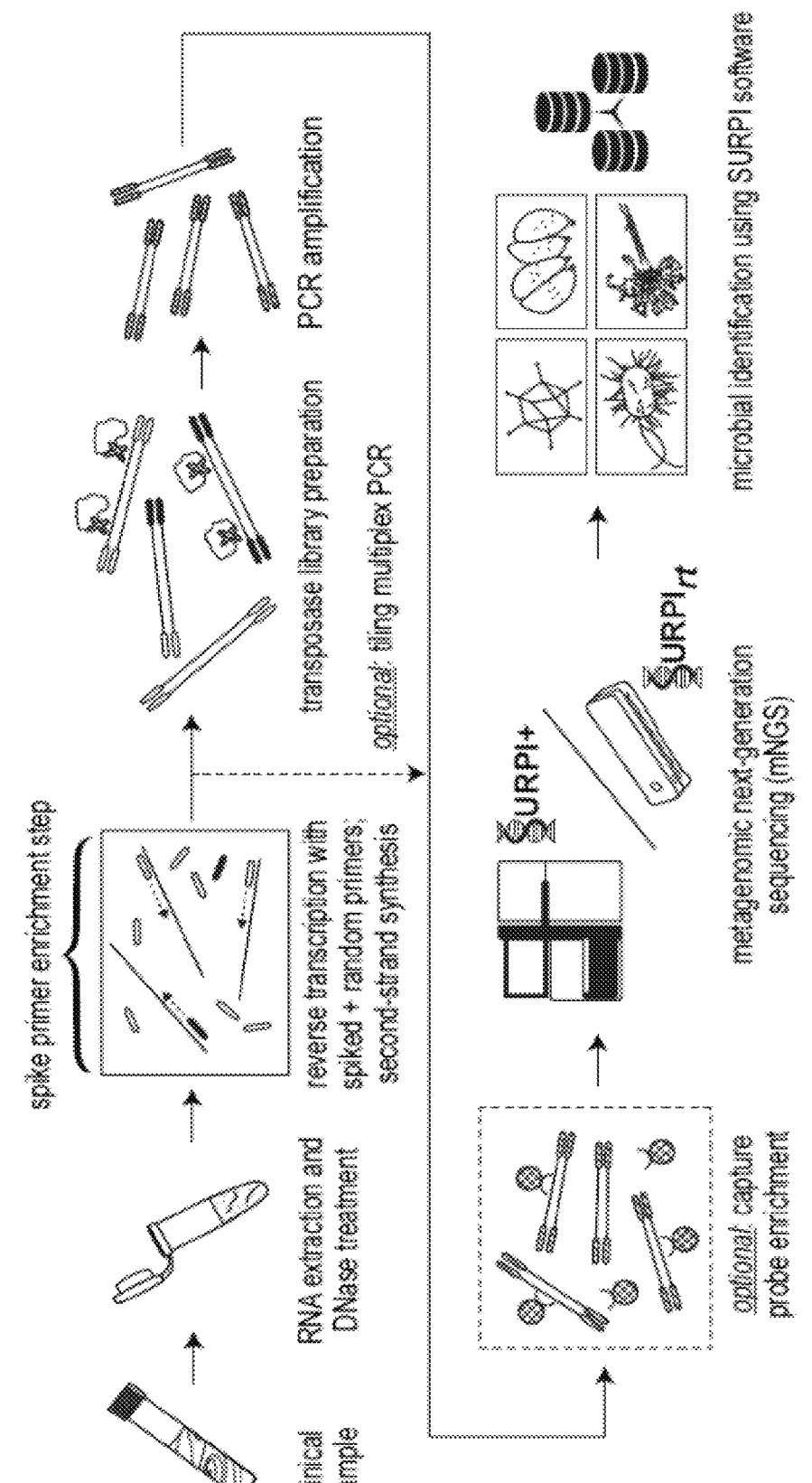

FIG. 10A depicts an algorithm for design of viral spiked primers. A set of viral reference genomes (60 to 3,571) were aligned using MAFFT multiple sequence alignment software (Katoh et al. (2014) supra), followed by partitioning of each genome into 300-500 nucleotide (nt) overlapping segments. Forward and reverse 13 nt primers ("kmers") were selected and filtered according to specific criteria (rounded rectangular box). Using this algorithm, primers were designed for 14 RNA viruses. Spiked primer panels for arboviruses (ArboV SP; n=4), hemorrhagic fever viruses (HFV SP; n=6), and all virus (AllV SP; n=13, excluding HCV) were also constructed. FIG. 10B depicts a metagenomic sequencing workflow. MSSPE primers are added ("spiked") to the reaction mix during the reverse transcription step of cDNA synthesis, without adding to the overall turnaround time for the library preparation and sequencing analysis protocols. The MSSPE workflow is compatible with subsequent enrichment using tiling multiplex PCR and/or capture probes (dotted lines). Metagenomic sequence data is analyzed for pathogen identification using SURPI software (Naccache et al. (2014) supra).

The performance of the spiked primer panels was evaluated on the MinION portable nanopore sequencing platform (Oxford Nanopore Technologies, Oxford, UK). The results are shown in the table provided in FIG. 11. As shown in FIG. 11, overall levels of ZIKV, EBOV, and DENV enrichment at viral titers ranging from 10-1,000 copies/mL were comparable for the two platforms (median enrichment of 7.8× on the MinION and 9.2× on the Illumina MiSeq). The use of spiked primer panels enabled detection of ZIKV and EBOV down to 10 copies/mL, near the limits of detection for virus-specific PCR (Cherpillod et al. (2016) *J Clin Virol* 77:9; Corman et al. (2016) *Bull World Health Organ* 94:880), whereas no ZIKV or EBOV reads were obtained by mNGS using RH primers alone.

It was hypothesized that the increased proportion of viral reads obtained using the MSSPE method would improve genome coverage. Using ZIKV spiked primers on plasma samples spiked with 1,000 copies/mL of ZIKV more than doubled the genome coverage obtained using RH primers only, from 35.8% to 72.8%. The performance of virus-specific primers for genome sequencing of ZIKV, DENV, EBOV, HIV-1 (divergent and recombinant strains from Cameroon and DRC, Africa), and HCV (genotypes 2, 4, and 6 from California, United States) was evaluated. The data are presented in the table provided in FIG. 12. As shown in the table presented in FIG. 12, on average, a 49% (±13.9% SD) increase in genome coverage was achieved using spiked primer relative to RH primers only for contrived ZIKV, DENV, HIV and EBOV samples at titers of 100-1,000 copies/mL, and a 42% (±15.0% SD) increase in genome coverage for clinical HIV-1 and HCV samples at titers ranging from 100-10,000 copies/mL. Similarly, a 36.5% (±16.8% SD) increase in genome coverage was obtained using spiked primer panels (ArboV, HFV, and AllV) for contrived and clinical samples of ZIKV, DENV, and EBOV. No significant gains in genome coverage were observed at a titer of 10 copies/mL, a finding attributed to insufficient sequencing depth. In addition, we tested the MSSPE method using EBOV and DENV spiked for genome recovery on the MinION nanopore sequencer. With contrived samples at a titer of 1,000 copies/mL, comparable percentage increases in genome coverage were achieved on both ONT MinION nanopore and Illumina MiSeq sequencing platforms.

To assess the utility of MSSPE for pathogen discovery, it was tested whether spiked primers could enrich for sequences from emerging flaviviruses in clinical samples from infected patients. Of note, flaviviruses had not been specifically targeted in the initial spiked primer design. ZIKV spiked primers were used to enrich for St. Louis encephalitis (SLEV), whereas ArboV panel spiked primers were used to enrich for Powassan virus (POWV) in patient cerebrospinal fluid (CSF) samples. As shown in the table presented in FIG. 13, use of ZIKV spiked primers enriched the number of reads to SLEV by ~3×, with a corresponding increase in 17.5% genome coverage. In CSF from a patient with tick-borne POWV meningoencephalitis, the use of ArboV spiked primers enriched for POWV reads by 15× over RH primers alone, and improved viral genome coverage by 43%. FIG. 13.

An HIV clinical sample was initially found to harbor Usutu virus (USUV), a flavivirus, by MSSPE using HIV-1 spiked primers. Interestingly, the degree of enrichment for USUV using these HIV-1 spiked primers over RH primers alone was 6×; subsequent analysis of the HIV-1 spiked primers found that 18 of them aligned incidentally to the USUV genome with 0 or 1 mismatches (92.3% or 100% identity). Running the same sample on the Illumina MiSeq at a limited throughput of ~1 million raw reads resulted in detection of no USUV reads with RH primers alone, but 6 reads with the use of ArboV primers. Deeper sequencing on the Illumina HiSeq of ~123 million reads revealed that the degree of enrichment of USUV reads using the ArboV panel was 7× (FIG. 13), with a corresponding increase in genome coverage of 25.6%.

Head-to-head comparisons were performed of MSSPE with both capture probe (Naccache et al. (2016) *Emerg Infect Dis* 22:1788) and tiling multiplex PCR (Quick et al. (2017) *Nat Protoc* 12:1261) methods for enrichment of viral reads from ZIKV-positive clinical samples at low titers (310-28,200 copies/mL). The degree of improvement in genome coverage using MSSPE was comparable to capture probe and tiling multiplex PCR methods. However, a small amount of cross-contamination was observed using capture probe and multiplex PCR, versus no cross-contamination using MSSPE. Tiling multiplex PCR for ZIKV was negative when testing a contrived ZIKV sample containing the 1947 prototype Uganda strain, likely due to sequence divergence from the Asian lineage reference genomes from the 2014-2016 ZIKV outbreak in the Americas that were used in the initial multiplex PCR primer design (Quick et al. (2017) supra).

The performance of MSSPE followed by subsequent tiling multiplex PCR or capture probe enrichment on low-titer contrived and clinical ZIKV samples (666-3,340 copies/mL) was evaluated. The use of spiked primers further increased the number of ZIKV reads by 3×-5× and corresponding genome coverage by 25%-80% (average 58.5±21.5%), as compared to RH primers alone. MSSPE was critical for ZIKV genome recovery in the two samples tested by tiling multiplex PCR, as multiplex PCR with the standard RH priming failed to yield a distinct band on gel electrophoresis, likely due to low abundance of virus in the samples.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

---

SEQUENCE LISTING (17383 sequences)

SEQ ID NO: 1 - protein, 7 aa, Artificial Sequence
  synthetic sequence
PKKKRKV

SEQ ID NO: 2 - protein, 16 aa, Artificial Sequence
  synthetic sequence
KRPAATKKAGQAKKKK

SEQ ID NO: 3 - protein, 9 aa, Artificial Sequence
  synthetic sequence
PAAKRVKLD

SEQ ID NO: 4 - protein, 11 aa, Artificial Sequence
  synthetic sequence
RQRRNELKRSP

SEQ ID NO: 5 - protein, 38 aa, Artificial Sequence
  synthetic sequence
NQSSNFGPMKGGNFGGRSSGPYGGGGQYFAKPRNQGGY

SEQ ID NO: 6 - protein, 42 aa, Artificial Sequence
  synthetic sequence
RMRIZFKNKGKDTAELRRRRVEVSVELRKAKKDEQILKRRNV

SEQ ID NO: 7 - protein, 8 aa, Artificial Sequence
  synthetic sequence
VSRKRPRP

SEQ ID NO: 8 - protein, 8 aa, Artificial Sequence
  synthetic sequence
PPKKARED

SEQ ID NO: 9 - protein, 8 aa, Artificial Sequence
  synthetic sequence
PQPKKKPL

SEQ ID NO: 10 - protein, 12 aa, Artificial Sequence
  synthetic sequence
SALIKKKKKMAP

SEQ ID NO: 11 - protein, 5 aa, Artificial Sequence
  synthetic sequence
DRLRR

SEQ ID NO: 12 - protein, 7 aa, Artificial Sequence
  synthetic sequence
PKQKKRK

SEQ ID NO: 13 - protein, 10 aa, Artificial Sequence
  synthetic sequence
RKLKKKIKKL

SEQ ID NO: 14 - protein, 10 aa, Artificial Sequence
  synthetic sequence
REKKKFLKRR

SEQ ID NO: 15 - protein, 20 aa, Artificial Sequence
  synthetic sequence
KRKGDEVDGVDEVAKKKSKK

SEQ ID NO: 16 - protein, 17 aa, Artificial Sequence
  synthetic sequence
RKCLQAGMNLEARKTKK

SEQ ID NO: 17 - DNA, 20 bp, Artificial Sequence
  synthetic sequence
aatgatacggcgaccaccga

SEQ ID NO: 18 - DNA, 20 bp, Artificial Sequence
  synthetic sequence
caagcagaagacggcatacg

SEQ ID NO: 19 - DNA, 55 bp, Artificial Sequence
  synthetic sequence
gcttgtggccgtttacgtcgccgtccagctcgaccaggatgggcaccaccccggc

SEQ ID NO: 20 - DNA, 55 bp, Artificial Sequence
  synthetic sequence
cgaacaccggcaaatgcagcggcaggtcgagctggtcctacccgtggtggggccg

SEQ ID NO: 21 - DNA, 29 bp, Artificial Sequence
  synthetic sequence
aacacaaggagacgcgccgccagccgacc

SEQ ID NO: 22 - DNA, 29 bp, Artificial Sequence
  synthetic sequence
gcttgtggccgtttacgtcgccgtccagc

SEQ ID NO: 23 - DNA, 39 bp, Artificial Sequence
  synthetic sequence
cgaacaccggcaaatgcagcggcaggtcgagctggtcct

SEQ ID NO: 24 - DNA, 26 bp, Artificial Sequence
  synthetic sequence
tcgaccaggatgggcaccaccccggc

SEQ ID NO: 25 - DNA, 16 bp, Artificial Sequence
  synthetic sequence
acccgtggtggggccg

SEQ ID NO: 26 - DNA, 29 bp, Artificial Sequence
  synthetic sequence
aacacaaggagacgcgccgccagccgacc

SEQ ID NO: 27 - DNA, 42 bp, Artificial Sequence
  synthetic sequence
acccgtggtggggccgtcgaccaggatgggcaccaccccggc

SEQ ID NO: 28 - DNA, 43 bp, Artificial Sequence
  synthetic sequence
atgggcaccaccccggcagctggtcctacccgtggtggggccg

SEQ ID NO: 29 - RNA, 41 nt, Artificial Sequence
  Synthetic sequence
uaauuucuacuaaguguagauaucauggcucagauugaacg

SEQ ID NO: 30 - RNA, 41 nt, Artificial Sequence
  Synthetic sequence
uaauuucuacuaaguguagaucaacccgaaggccuucuuca

SEQ ID NO: 31 - RNA, 41 nt, Artificial Sequence
  Synthetic sequence
uaauuucuacuaaguguagaucgcccaguaauuccgauuaa

SEQ ID NO: 32 - RNA, 41 nt, Artificial Sequence
  Synthetic sequence
uaauuucuacuaaguguagaucggcguggacuaccagggua

SEQ ID NO: 33 - RNA, 41 nt, Artificial Sequence
  Synthetic sequence
uaauuucuacuaaguguagauauucgaugcaacgcgaagaa

SEQ ID NO: 34 - RNA, 41 nt, Artificial Sequence
  Synthetic sequence
uaauuucuacuaaguguagauacaacacgagcugacgacag

SEQ ID NO: 35 - DNA, 50 bp, Artificial Sequence
  synthetic sequence
agctgacgtgtactccagcgtctcatctatgcgtcagcagagattctgct

SEQ ID NO: 36 - DNA, 60 bp, Artificial Sequence
  synthetic sequence
ccagcgttcagcagaatctctgctgacgcatagatgagacgctggagtacacgtcagcta

SEQ ID NO: 37 - DNA, 60 bp, Artificial Sequence
  synthetic sequence
gtatgaagaagcagaatctctgctgacgcatagatgagacgctggagtacacgtcagcta

SEQ ID NO: 38 - DNA, 60 bp, Artificial Sequence
  synthetic sequence
cgttaatcgagcagaatctctgctgacgcatagatgagacgctggagtacacgtcagcta

SEQ ID NO: 39 - DNA, 59 bp, Artificial Sequence
  synthetic sequence
ggttcttcagcagaatctctgctgacgcatagatgagacgctggagtacacgtcagcta

SEQ ID NO: 40 - DNA, 60 bp, Artificial Sequence
  synthetic sequence
tggctgtcgagcagaatctctgctgacgcatagatgagacgctggagtacacgtcagcta

SEQ ID NO: 41 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 42 - protein, 872 aa, Alicyclobacillus contaminans
MGFNTAELLRKVEEEMRKTSVGFDTDNPFAHRITRRAIRGWDRIAEAWRRLPPDAPESEYIEAFKDIQRKNPRKIGSEPLFKNLAAPGVRSELLNNPQVLITFAKYNELQRQLAKAKQFAQKTLPHPVFHPVWVRYDKLGGNLHHYQIEPAVHANDTHKVKFSSLLLPQEDGSYAEVKDVTVSLAPSLQFPTGLVHPKVTTPPRTGLVTVMDEEAGKPVVCYRDRGHDALVPVAFGGAKLQFNRAHLSAGYRKGVLSAGGGGSIYFNVTLDVQVPNERDVSKTFSFSRDRDLVSLKAEELKRYMETKPLGMPGVRVMSVDLGVRYGAAISVFEVKPFAEVRKDKLHYPITGCEGFVAEHERSVILKLPGEGVRTAGKQSERKQALAAIRAEMSILRKWLRVSQVTEEDRAKAVRGLLEDERGGGWTMDPGEDSDHQPLQQFLHEARLAVGELVNLVHLSPAEWERAVIERHRRLERITASHIRVFQTMRKVWGKRRNEDAAHTGGISLAHIEHLIQQRKLFIRWSTHARTYGEVRRLPKHEGFAKRLQKHTNHVKEDRIKKLADMIVMAARGYRFLDKRARWVKTRHAPCDLILFEDLSRYRFTMDRPPTENSQLMNWSHRELLKTVKMQAALFGIGVGTVPAAFTSRFDAQTGAPGLRCKRVTKQDKEKTPFWLIQFAEITGVNVTNVEPGQLIPVDGGEWFVSPKGPRAADGLKCVHADINAAHNLQRRFWIPRLPSVKCRRYVEAEGFAAVPSSTAFMKVHGKGAFVSVDGEFYEYQKGRRVAVNRADRTSSTLDEDEGDIGEEMLVSSNGAGEFVRMFYDESGYVGYGRWMDSKVFWGKVRQIVHRAIQDQVEKRAAARGENGATSSR

SEQ ID NO: 43 - protein, 1149 aa, Desulfovibrio inopinatus
MPTRTINLKLVLGKNPENATLRRALFSTHRLVNQATKRIEEFLLLCRGEAYRTVDNEGKEAEIPRHAVQEEALAFAKAAQRHNGCISTYEDQEILDVLRQLYERLVPSVNENNEAGDAQAANAWVSPLMSAESEGGLSVYDKVLDPPPVWMKLKEEKAPGWEAASQIWIQSDEGQSLLNKPGSPPRWIRKLRSGQPWQDDFVSDQKKKQDELTKGNAPLIKQLKEMGLLPLVNPFFRHLLDPEGKGVSPWDRLAVRAAVAHFISWESWNHRTRAEYNSLKLRRDEFEAASDEFKDDFTLLRQYEAKRHSTLKSIALADDSNPYRIGVRSLRAWNRVREEWIDKGATEEQRVTILSKLQTQLRGKFGDPDLFNWLAQDRHVHLWSPRDSVTPLVRINAVDKVLRRRKPYALMTFAHPRFHPRWILYEAPGGSNLRQYALDCTENALHITLPLLVDDAHGTWIEKKIRVPLAPSGQIQDLTLEKLEKKKNRLYYRSGFQQFAGLAGGAEVLFHRPYMEHDERSEESLLERPGAVWFKLTLDVATQAPPNWLDGKGRVRTPPEVHHFKTALSNKSKHTRTLQPGLRVLSVDLGMRTFASCSVFELIEGKPETGRAFPVADERSMDSPNKLWAKHERSFKLTLPGETPSRKEEEERSIARAEIYALKRDIQRLKSLLRLGEEDNDNRRDALLEQFFKGWGEEDVVPGQAFPRSLFQGLGAAPFRSTPELWRQHCQTYYDKAEACLAKHISDWRKRTRPRPTSREMWYKTRSYHGGKSIWMLEYLDAVRKLLLSWSLRGRTYGAINRQDTARFGSLASRLLHHINSLKEDRIKTGADSIVQAARGYIPLPHGKGWEQRYEPCQLILFEDLARYRFRVDRPRRENSQLMQWNHRAIVAETTMQAELYGQIVENTAAGFSSRFHAATGAPGVRCRFLLERDFDNDLPKPYLLRELSWMLGNTKVESEEEKLRLLSEKIRPGSLVPWDGGEQFATLHPKRQTLCVIHADMNAAQNLQRRFFGRCGEAFRLVCQPHGDDVLRLASTPGARLLGALQQLENGQGAFELVRDMGSTSQMNRFVMKSLGKKKIKPLQDNNGDDELEDVLSVLPEEDDTGRITVFRDSSGIFFPCNVWIPAKQFWPAVRAMIWKVMASHSLG

SEQ ID NO: 44 - protein, 1194 aa, Desulfonatronum thiodismutans
MVLGRKDDTAELRRALWTTHEHVNLAVAEVERVLLRCRGRSYWTLDRRGDPVHVPESQVAEDALAMAREAQRRNGWPVVGEDEEILLALRYLYEQIVPSCLLDDLGKPLKGDAQKIGTNYAGPLFDSDTCRRDEGKDVACCGPFHEVAGKYLGALPEWATPISKQEFDGKDASHLRFKATGGDDAFFRVSIEKANAWYEDPANQDALKNKAYNKDDWKKEKDKGISSWAVKYIQKQLQLGQDPRTEVRRKLWLELGLLPLFIPVFDKTMVGNLWNRLAVRLALAHLLSWESWNHRAVQDQALARAKRDELAALFLGMEDGFAGLREYELRRNESIKQHAFEPVDRPYVVSGRALRSWTRVREEWLRHGDTQESRKNICNRLQDRLRGKFGDPDVFHWLAEDGQEALWKERDCVTSFSLLNDADGLLEKRKGYALMTFADARLHPRWAMYEAPGGSNLRTYQIRKTENGLWADVVLLSPRNESAAVEEKTFNVRLAPSGQLSNVSFDQIQKGSKMVGRCRYQSANQQFEGLLGGAEILFDRKRIANEQHGATDLASKPGHVWFKLTLDVRPQAPQGWLDGKGRPALPPEAKHFKTALSNKSKFADQVRPGLRVLSVDLGVRSFAACSVFELVRGGPDQGTYFPAADGRTVDDPEKLWAKHERSFKITLPGENPSRKEEIARRAAMEELRSLNGDIRRLKAILRLSVLQEDDPRTEHLRLFMEAIVDDPAKSALNAELFKGFGDDRFRSTPDLWKQHCHFFHDKAEKVVAERFSRWRTETRPKSSSWQDWRERRGYAGGKSYWAVTYLEAVRGLILRWNMRGRTYGEVNRQDKKQFGTVASALLHHINQLKEDRIKTGADMIIQAARGFVPRKNGAGWVQVHEPCRLILFEDLARYRFRTDRSRRENSRLMRWSHREIVNEVGMQGELYGLHVDTTEAGFSSRYLASSGAPGVRCRHLVEEDFHDGLPGMHLVGELDWLLPKDKDRTANEARRLLGGMVRPGMLVPWDGGELFATLNAASQLHVIHADINAAQNLQRRFWGRCGEAIRIVCNQLSVDGSTRYEMAKAPKARLLGALQQLKNGDAPFHLTSIPNSQKPENSYVMTPTNAGKKYRAGPGEKSSGEEDELALDIVEQAEELAQGRKTFFRDPSGVFFAPDRWLPSEIYWSRIRRRIWQVTLERNSSGRQERAEMDEMPY

SEQ ID NO: 45 - protein, 1388 aa, Opitutaceae bacterium
MSLNRIYQGRVAAVETGTALAKGNVEWMPAAGGDEVLWQHHELFQAAINYYLVALLALADKNNPVLGPLISQMDNPQSPYHVWGSFRRQGRQRTGLSQAVAPYITPGNNAPTLDEVFRSILAGNPTDRATLDAALMQLLKACDGAGAIQQEGRSYWPKFCDPDSTANFAGDPAMLRREQHRLLLPQVLHDPAITHDSPALGSFDTYSIATPDTRTPQLTGPKARARLEQAITLWRVRLPESAADFDRLASSLKKIPDDDSRLNLQGYVGSSAKGEVQARLFALLLFRHLERSSFTLGLLRSATPPPKNAETPPPAGVPLPAASAADPVRIARGKRSFVFRAFTSLPCWHGGDNIHPTWKSFDIAAFKYALTVINQIEEKTKERQKECAELETDFDYMHGRLAKIPVKYTTGEAEPPPILANDLRIPLLRELLQNIKVDTALTDGEAVSYGLQRRTIRGFRELRRIWRGHAPAGTVFSSELKEKLAGELRQFQTDNSTTIGSVQLFNELIQNPKYWPIWQAPDVETARQWADAGFADDPLAALVQEAELQEDIDALKAPVKLTPADPEYSRRQYDFNAVSKFGAGSRSANRHEPGQTERGHNTFTTEIAARNAADGNRWRATHVRIHYSAPRLLRDGLRRPDTDGNEALEAVPWLQPMMEALAPLPTLPQDLTGMPVFLMPDVTLSGERRILLNLPVTLEPAALVEQLGNAGRWQNQFFGSREDPFALRWPADGAVKTAKGKTHIPWHQDRDHFTVLGVDLGTRDAGALALLNVTAQKPAKPVHRIIGEADGRTWYASLADARMIRLPGEDARLFVRGKLVQEPYGERGRNASLLEWEDARNIILRLGQNPDELLGADPRRHSYPEINDKLLVALRRAQARLARLQNRSWRLRDLAESDKALDEIHAERAGEKPSPLPPLARDDAIKSTDEALLSQRDIIRRSFVQIANLILPLRGRRWEWRPHVEVPDCHILAQSDPGTDDTKRLVAGQRGISHERIEQIEELRRRCQSLNRALRHKPGERPVLGRPAKGEEIADPCPALLEKINRLRDQRVDQTAHAILAAALGVRLRAPSKDRAERRHRDIHGEYERFRAPADFVVIENLSRYLSSQDRARSENTRLMQWCHRQIVQKLRQLCETYGIPVLAVPAAYSSRFSSRDGSAGFRAVHLTPDHRHRMPWSRILARLKAHEEDGKRLEKTVLDEARAVRGLFDRLDRFNAGHVPGKPWRTLLAPLPGGPVFVPLGDATPMQADLNAAINIALRGIAAPDRHDIHHRLRAENKKRILSLRLGTQREKARWPGGAPAVTLSTPNNGASPEDSDALPERVSNLFVDIAGVANFERVTIEGVSQKFATGRGLWASVKQRAWNRVARLNETVTDNNRNEEEDDIPM

SEQ ID NO: 46 - protein, 1132 aa, Tuberibacillus calidus
MATKSFILKMKTKNNPQLRLSLWKTHELFNFGVAYYMDLLSLFRQKDLYMHNDEDPDHPVVLKKEEIQERLWMKVRETQQKNGFHGEVSKDEVLETLRALYEELVPSAVGKSGEANQISNKYLYPLTDPASQSGKGTANSGRKPRWKKLKEAGDPSWKDAYEKWEKERQEDPKLKILAALQSFGLIPLFRPFTENDHKAVISVKWMPKSKNQSVRKFDKDMFNQAIERFLSWESWNEKVAEDYEKTVSIYESLQKELKGISTKAFEIMERVEKAYEAHLREITFSNSTYRIGNRAIRGWTEIVKKWMKLDPSAPQGNYLDVVKDYQRRHPRESGDFKLFELLSRPENQAAWREYPEFLPLYVKYRHAEQRMKTAKKQATFTLCDPIRHPLWVRYEERSGTNLNKYRLIMNEKEKVVQFDRLICLNADGHYEEQEDVTVPLAPSQQFDDQIKFSSEDTGKGKHNFSYYHKGINYELKGTLGGARIQFDREHLLRRQGVKAGNVGRIFLNVTLNIEPMQPFSRSGNLQTSVGKALKVYVDGYPKVVNFKPKELTEHIKESEKNTLTLGVESLPTGLRVMSVDLGQRQAAAISIFEVVSEKPDDNKLFYPVKDTDLFAVHRTSFNIKLPGEKRTERRMLEQQKRDQAIRDLSRKLKFLKNVLNMQKLEKTDEREKRVNRWIKDREREEENPVYVQEFEMISKVLYSPHSVWVDQLKSIHRKLEEQLGKEISKWRQSISQGRQGVYGISLKNIEDIEKTRRLLFRWSMRPENPGEVKQLQPGERFAIDQQNHLNHLKDDRIKKLANQIVMTALGYRYDGKRKKWIAKHPACQLVLFEDLSRYAFYDERSRLENRNLMRWSRREIPKQVAQIGGLYGLLVGEVGAQYSSRFHAKSGAPGIRCRVVKEHELYITEGGQKVRNQKFLDSLVENNIIEPDDARRLEPGDLIRDQGGDKFATLDERGELVITHADINAAQNLQKRFWTRTHGLYRIRCESREIKDAVVLVPSDKDQKEKMENLFGIGYLQPFKQENDVYKWVKGEKIKGKKTSSQSDDKELVSEILQEASVMADELKGNRKTLFRDPSGYVFPKDRWYTGGRYFGTLEHLLKRKLAERRLFDGGSSRRGLFNGTDSNTNVE

SEQ ID NO: 47 - protein, 658 aa, Methylobacterium nodulans
MLTKQDKQQKITYCTNMNEVFEAKLGSADLLLNWDHLRGRIRDRVDAGDIGSAFLKLALDVAHVLPDGVDDQLARAAFHFQSAKGAKSKHADSVQAGLRVLSIDLGVRSFATCSVFELKDTAPTTGVAFPLAEFRLWAVHERSFTLELPGENVGAAGQQWRAQADAELRQLRGGLNRHRQLLRAATVQKGERDAYLTDLREAWSAKELWPFEASLLSELERCSTVADPLWQDTCKRAARLYRTEFGAVVSEWRSRTRSREDRKYAGKSMWSVQHLTDVRRFLQSWSLAGRASGDIRRLDRERGGVFAKDLLDHIDALKDDRLKTGADLIVQAARGFQRNEFGYWVQKHAPCHVILFEDLSRYRMRTDRPRRENSQLMQWAHRGVPDMVGMQGEIYGIQDRRDPDSARKHARQPLAAFCLDTPAAFSSRYHASTMTPGIRCHPLRKREFEDQGFLELLKRENEGLDLNGYKPGDLVPLPGGEVFVCLNANGLSRIHADINAAQNLQRRFWTQHGDAFRLPCGKSAVQGQIRWAPLSMGKRQAGALGGFGYLEPTGHDSGSCQWRKTTEAEWRRLSGAQKDRDEAAAAEDEELQGLEEELLERSGERVVFFRDPSGVVLPTDLWFPSAAFWSIVRAKTVGRLRSHLDAQAEASYAVAAGL

SEQ ID NO: 48 - protein, 864 aa, Brevibacillus sp.
MPKILRGHKWISLLEQYEENRERELRENMTAANDKYRITKRQMKGWNELYELWSTFPASASHEQYKEALKRVQQRLRGRFGDAHFFQYLMEEKNRLIWKGNPQRIHYFVARNELTKRLEEAKQSATMTLPNARKHPLWVRFDARGGNLQDYYLTAEADKPRSRRFVTFSQLIWPSESGWMEKKDVEVELALSRQFYQQVKLLKNDKGKQKIEFKDKGSGSTFNGHLGGAKLQLERGDLEKEEKNFEDGEIGSVYLNVVIDFEPLQEVKNGRVQAPYGQVLQLIRRPNEFPKVTTYKSEQLVEWIKASPQHSAGVESLASGFRVMSIDLGLRAAAATSIFSVEESSDKNAADFSYWIEGTPLVAVHHRSYMLRLPGEQVEKQVMEKRDERFQLHQRVKFQIRVLAQIMRMANKQYGDRWDELDSLKQAVEQKKSPLDQTDRTFWEGIVCDLTKVLPRNEADWEQAVVQIHRKAEEYVGKAVQAWRKRFAADERKGIAGLSMWNIEELEGLRKLLISWSRRSRNPQEVNRFERGHTSHQRLLTHIQNVKEDRLKQLSHAIVMTALGYVYDERKQEWCAEYPACQVILFENLSQYRSNLDRSTKENSTLMKWAHRSIPKYVHMQAEPYGIQIGDVRAEYSSRFYAKTGTPGIRCKKVRGQDLQGRRFENLQKRLVNEQFLTEEQVKQLRPGDIVPDDSGELFMTLTDGSGSKEVVFLQADINAAHNLQKRFWQRYNELFKVSCRVIVRDEEEYLVPKTKSVQAKLGKGLFVKKSDTAWKDVYVWDSQAKLKGKTTFTEESESPEQLEDFQEIIEEAEEAKGTYRTLFRDPSGVFFPESVWYPQKDFWGEVKRKLYGKLRERFLTKAR

SEQ ID NO: 49 - protein, 1108 aa, Bacillus sp.
MAIRSIKLKLKTHTGPEAQNLRKGIWRTHRLLNEGVAYYMKMLLLFRQESTGERPKEELQEELICHIREQQQRNQADKNTQALPLDKALEALRQLYELLVPSSVGQSGDAQIISRKFLSPLVDPNSEGGKGTSKAGAKPTWQKKKEANDPTWEQDYEKWKKRREEDPTASVITTLEEYGIRPIFPLYTNTVTDIAWLPLQSNQFVRTWDRDMLQQAIERLLSWESWNKRVQEEYAKLKEKMAQLNEQLEGGQEWISLLEQYEENRERELRENMTAANDKYRITKRQMKGWNELYELWSTFPASASHEQYKEALKRVQQRLRGRFGDAHFFQYLMEEKNRLIWKGNPQRIHYFVARNELTKRLEEAKQSATMTLPNARKHPLWVRFDARGGNLQDYYLTAEADKPRSRRFVTFSQLIWPSESGWMEKKDVEVELALSRQFYQQVKLLKNDKGKQKIEFKDKGSGSTFNGHLGGAKLQLERGDLEKEEKNFEDGEIGSVYLNVVIDFEPLQEVKNGRVQAPYGQVLQLIRRPNEFPKVTTYKSEQLVEWIKASPQHSAGVESLASGFRVMSIDLGLRAAAATSIFSVEESSDKNAADFSYWIEGTPLVAVHQRSYMLRLPGEQVEKQVMEKRDERFQLHQRVKFQIRVLAQIMRMANKQYGDRWDELDSLKQAVEQKKSPLDQTDRTFWEGIVCDLTKVLPRNEADWEQAVVQIHRKAEEYVGKAVQAWRKRFAADERKGIAGLSMWNIEELEGLRKLLISWSRRTRNPQEVNRFERGHTSHQRLLTHIQNVKEDRLKQLSHAIVMTALGYVYDERKQEWCAEYPACQVILFENLSQYRSNLDRSTKENSTLMKWAHRSIPKYVHMQAEPYGIQIGDVRAEYSSRFYAKTGTPGIRCKKVRGQDLQGRRFENLQKRLVNEQFLTEEQVKQLRPGDIVPDDSGELFMTLTDGSGSKEVVFLQADINAAHNLQKRFWQRYNELFKVSCRVIVRDEEEYLVPKTKSVQAKLGKGLFVKKSDTAWKDVYVWDSQAKLKGKTTFTEESESPEQLEDFQEIIEEAEEAKGTYRTLFRDPSGVFFPESVWYPQKDFWGEVKRKLYGKLRERFLTKAR

SEQ ID NO: 50 - protein, 1489 aa, Desulfatirhabdium butyrativorans
MPLSNNPPVTQRAYTLRLRGADPSDLSWREALWHTHEAVNKGAKVFGDWLLTLRGGLDHTLADTKVKGGKGKPDRDPTPEERKARRILLALSWLSVESKLGAPSSYIVASGDEPAKDRNDNVVSALEEILQSRKVAKSEIDDWKRDCSASLSAAIRDDAVWVNRSKVFDEAVKSVGSSLTREEAWDMLERFFGSRDAYLTPMKDPEDKSSETEQEDKAKDLVQKAGQWLSSRYGTSEGADFCRMSDIYGKIAAWADNASQGGSSTVDDLVSELRQHFDTKESKATNGLDWIIGLSSYTGHTPNPVHELLRQNTSLNKSHLDDLKKKANTRAESCKSKIGSKGQRPYSDAILNDVESVCGFTYRVDKDGQPVSVADYSKYDVDYKWGTARHYIFAVMLDHAARRISLAHKWIKRAEAERHKFEEDAKRIANVPARAREWLDSFCKERSVTSGAVEPYRIRRRAVDGWKEVVAAWSKSDCKSTEDRIAAARALQDDSEIDKFGDIQLFEALAEDDALCVWHKDGEATNEPDFQPLIDYSLAIEAEFKKRQFKVPAYRHPDELLHPVFCDFGKSRWKINYDVHKNVQAPFYRGLCLTLWTGSEIKPVPLCWQSKRLTRDLALGNNHRNDAASAVTRADRLGRAASNVTKSDMVNITGLFEQADWNGRLQAPRQQLEAIAVVRDNPRLSEQERNLRMCGMIEHIRWLVTFSVKLQPQGPWCAYAEQHGLNTNPQYWPHADTNRDRKVHARLILPRLPGLRVLSVDLGHRYAAACAVWEAVNTETVKEACQNVGRDMPKEHDLYLHIKVKKQGIGKQTEVDKTTIYRRIGADTLPDGRPHPAPWARLDRQFLIKLQGEEKDAREASNEEIWALHQMECKLDRTKPLIDRLIASGWGLLKRQMARLDALKELGWIPAPDSSENLSREDGEAKDYRESLAVDDLMFSAVRTLRLALQRHGNRARIAYYLISEVKIRPGGIQEKLDENGRIDLLQDALALWHELFSSPGWRDEAAKQLWDSRIATLAGYKAPEENGDNVSDVAYRKKQQVYREQLRNVAKTLSGDVITCKELSDAWKERWEDEDQRWKKLLRWFKDWVLPSGTQANNATIRNVGGLSLSRLATITEFRRKVQVGFFTRLRPDGTRHEIGEQFGQKTLDALELLREQRVKQLASRIAEAALGIGSEGGKGWDGGKRPRQRINDSRFAPCHAVVIENLANYRPDETRTRLENRRLMTWSASKVHKYLSEACQLNGLYLCTVSAWYTSRQDSRTGAPGIRCQDVSVREFMQSPFWRKQVKQAEAKHDENKGDARERFLCELNKTWKAKTPAEWKKAGFVRIPLRGGEIFVSADSKSPSAKGIHADLNAAANIGLRALTDPDWPGKWWYVPCDPVSFESKMDYVKGCAAVKVGQPLRQPAQTNADGAASKIRKGKKNRTAGTSKEKVYLWRDISAFPLESNEIGEWKETSAYQNDVQYRVIRMLKEHIKSLDNRTGDNVEG

SEQ ID NO: 51 - protein, 1228 aa, Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 52 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 53 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 54 - protein, 1246 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSESEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQIIGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 55 - protein, 1373 aa, Moraxella bovoculi
MLFQDFTHLYPLSKTVRFELKPIDRTLEHIHAKNFLSQDETMADMHQKVKVILDDYHRDFIADMMGEVKLTKLAEFYDVYLKFRKNPKDDELQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFDKINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWTICSHGDKRYVYDKTANQNKGAAKGINVNDELKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 56 - protein, 1259 aa, Moraxella bovoculi
MGIHGVPAALFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPKVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 57 - protein, 1269 aa, Moraxella bovoculi
MGIHGVPAALFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMIYKLLPGPNKMLPKVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 58 - protein, 1306 aa, Thiomicrospira sp.
MGIHGVPAATKTFDSEFFNLYSLQKTVRFELKPVGETASFVEDFKNEGLKRVVSEDERRAVDYQKVKEIIDDYHRDFIEESLNYFPEQVSKDALEQAFHLYQKLKAAKVEEREKALKEWEALQKKLREKVVKCFSDSNKARFSRIDKKELIKEDLINWLVAQNREDDIPTVETFNNFTTYFTGFHENRKNIYSKDDHATAISFRLIHENLPKFFDNVISFNKLKEGFPELKFDKVKEDLEVDYDLKHAFEIEYFVNFVTQAGIDQYNYLLGGKTLEDGTKKQGMNEQINLFKQQQTRDKARQIPKLIPLFKQILSERTESQSFIPKQFESDQELFDSLQKLHNNCQDKFTVLQQAILGLAEADLKKVFIKTSDLNALSNTIFGNYSVFSDALNLYKESLKTKKAQEAFEKLPAHSIHDLIQYLEQFNSSLDAEKQQSTDTVLNYFIKTDELYSRFIKSTSEAFTQVQPLFELEALSSKRRPPESEDEGAKGQEGFEQIKRIKAYLDTLMEAVHFAKPLYLVKGRKMIEGLDKDQSFYEAFEMAYQELESLIIPIYNKARSYLSRKPFKADKFKINFDNNTLLSGWDANKETANASILFKKDGLYYLGIMPKGKTFLFDYFVSSEDSEKLKQRRQKTAEEALAQDGESYFEKIRYKLLPGASKMLPKVFFSNKNIGFYNPSDDILRIRNTASHTKNGTPQKGHSKVEFNLNDCHKMIDFFKSSIQKHPEWGSFGFTFSDTSDFEDMSAFYREVENQGYVISFDKIKETYIQSQVEQGNLYLFQIYNKDFSPYSKGKPNLHTLYWKALFEEANLNNVVAKLNGEAEIFFRRHSIKASDKVVHPANQAIDNKNPHTEKTQSTFEYDLVKDKRYTQDKFFFHVPISLNFKAQGVSKFNDKVNGFLKGNPDVNIIGIDRGERHLLYFTVVNQKGEILVQESLNTLMSDKGHVNDYQQKLDKKEQERDAARKSWTTVENIKELKEGYLSHVVHKLAHLIIKYNAIVCLEDLNFGFKRGRFKVEKQVYQKFEKALIDKLNYLVFKEKELGEVGHYLTAYQLTAPFESFKKLGKQSGILFYVPADYTSKIDPTTGFVNFLDLRYQSVEKAKQLLSDFNAIRFNSVQNYFEFEIDYKKLTPKRKVGTQSKWVICTYGDVRYQNRRNQKGHWETEEVNVTEKLKALFASDSKTTTVIDYANDDNLIDVILEQDKASFFKELLWLLKLTMTLRHSKIKSEDDFILSPVKNEQGEFYDSRKAGEVWPKDADANGAYHIALKGLWNLQQINQWEKGKTLNLAIKNQDWFSFIQEKPYQE

SEQ ID NO: 59 - protein, 1214 aa, Butyrivibrio sp.
MGIHGVPAAYYQNLTKKYPVSKTIRNELIPIGKTLENIRKNNILESDVKRKQDYEHVKGIMDEYHKQLINEALDNYMLPSLNQAAEIYLKKHVDVEDREEFKKTQDLLRREVTGRLKEHENYTKIGKKDILDLLEKLPSISEEDYNALESFRNFYTYFTSYNKVRENLYSDEEKSSTVAYRLINENLPKFLDNIKSYAFVKAAGVLADCIEEEEQDALFMVETFNMTLTQEGIDMYNYQIGKVNSAINLYNQKNHKVEEFKKIPKMKVLYKQILSDREEVFIGEFKDDETLLSSIGAYGNVLMTYLKSEKINIFFDALRESEGKNVYVKNDLSKTTMSNIVFGSWSAFDELLNQEYDLANENKKKDDKYFEKRQKELKKNKSYTLEQMSNLSKEDISPIENYIERISEDIEKICIYNGEFEKIVVNEHDSSRKLSKNIKAVKVIKDYLDSIKELEHDIKLINGSGQELEKNLVVYVGQEEALEQLRPVDSLYNLTRNYLTKKPFSTEKVKLNFNKSTLLNGWDKNKETDNLGILFFKDGKYYLGIMNTTANKAFVNPPAAKTENVFKKVDYKLLPGSNKMLPKVFFAKSNIGYYNPSTELYSNYKKGTHKKGPSFSIDDCHNLIDFFKESIKKHEDWSKFGFEFSDTADYRDISEFYREVEKQGYKLTFTDIDESYINDLIEKNELYLFQIYNKDFSEYSKGKLNLHTLYFMMLFDQRNLDNVVYKLNGEAEVFYRPASIAENELVIHKAGEGIKNKNPNRAKVKETSTFSYDIVKDKRYSKYKFTLHIPITMNFGVDEVRRFNDVINNALRTDDNVNVIGIDRGERNLLYVVVINSEGKILEQISLNSIINKEYDIETNYHALLDEREDDRNKARKDWNTIENIKELKTGYLSQVVNVVAKLVLKYNAIICLEDLNFGFKRGRQKVEKQVYQKFEKMLIEKLNYLVIDKSREQVSPEKMGGALNALQLTSKFKSFAELGKQSGIIYYVPAYLTSKIDPTTGFVNLFYIKYENIEKAKQFFDGFDFIRFNKKDDMFEFSFDYKSFTQKACGIRSKWIVYTNGERIIKYPNPEKNNLFDEKVINVTDEIKGLFKQYRIPYENGEDIKEIIISKAEADFYKRLFRLLHQTLQMRNSTSDGTRDYIISPVKNDRGEFFCSEFSEGTMPKDADANGAYNIARKGLWVLEQIRQKDEGEKVNLSMTNAEWLKYAQLHLL

SEQ ID NO: 60 - protein, 1129 aa, Artificial Sequence; identical to SEQ ID NO: 41
  synthetic sequence

SEQ ID NO: 61 - RNA, 20 nt, Artificial Sequence
  synthetic sequence
aauuucuacuaaguguagau

SEQ ID NO: 62 - RNA, 19 nt, Artificial Sequence
  synthetic sequence
aauuucuacucuuguagau

SEQ ID NO: 63 - RNA, 19 nt, Artificial Sequence
  synthetic sequence
aauuucuacuguuguagau

SEQ ID NO: 64 - RNA, 19 nt, Artificial Sequence
  synthetic sequence
aauuucuacuauuguagau

SEQ ID NO: 65 - RNA, 20 nt, Artificial Sequence
  synthetic sequence
aauuucuacuguuuguagau

SEQ ID NO: 66 - RNA, 19 nt, Artificial Sequence
  synthetic sequence
aauuucuacuguuguagau

SEQ ID NO: 67 - RNA, 19 nt, Artificial Sequence
  synthetic sequence
aauuucuacuauuguagau

SEQ ID NO: 68 - RNA, 91 nt, Artificial Sequence
  synthetic sequence
gucuagaggacagaauuuuucaacgggugugccaauggccacuuuccagguggcaaagcccguugagcuucucaaaucugagaaguggcac

SEQ ID NO: 69 - protein, 986 aa, Artificial Sequence
  synthetic sequence
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 70 - protein, 978 aa, Artificial Sequence
  synthetic sequence
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 71 - DNA, 13 bp, Artificial Sequence
  synthetic sequence
cccacgttgacac

SEQ ID NO: 72 - DNA, 13 bp, Artificial Sequence
  synthetic sequence
aaatgaaagatag

SEQ ID NO: 73 - DNA, 13 bp, Artificial Sequence
  synthetic sequence
ggcttgaaaagat

SEQ ID NO: 74 - DNA, 13 bp, Artificial Sequence
  synthetic sequence
tttatcagaaggt

SEQ ID NO: 75 - DNA, 13 bp, Artificial Sequence
  synthetic sequence
gcatctcagttgt

SEQ ID NO: 76 - DNA, 13 bp, Artificial Sequence
  synthetic sequence
aaaaaccatttga

SEQ ID NO: 77 - DNA, 13 bp, Artificial Sequence
  synthetic sequence
gaagacataggct

SEQ ID NO: 78 - DNA, 13 bp, Artificial Sequence
  synthetic sequence
cttggatgagcaa

SEQ ID NO: 79 - DNA, 13 bp, Artificial Sequence
  synthetic sequence
acaacatcagatg

SEQ ID NO: 80 - DNA, 13 bp, Artificial Sequence
  synthetic sequence
gtgacagaaagaa

SEQ ID NO: 81 - DNA, 13 bp, Artificial Sequence
  synthetic sequence
ttcaccatgcaac

SEQ ID NO: 82 - DNA, 13 bp, Artificial Sequence
  synthetic sequence
gagaaaaatttcc

SEQ ID NO: 83 - DNA, 13 bp, Artificial Sequence
  synthetic sequence
gaagagggaatct

SEQ ID NO: 84 - DNA, 13 bp, Artificial Sequence
  synthetic sequence
aacattgcaagac

SEQ ID NO: 85 - DNA, 13 bp, Artificial Sequence
  synthetic sequence
acaccttatgaag

SEQ ID NO: 86 - DNA, 13 bp, Artificial Sequence
  synthetic sequence
taacttctcggct

SEQ ID NO: 87 - DNA, 13 bp, Artificial Sequence
  synthetic sequence
gcagtcaaaccta

SEQ ID NO: 88 - DNA, 13 bp, Artificial Sequence
  synthetic sequence
taggaaatgaact

SEQ ID NO: 89 - DNA, 13 bp, Artificial Sequence
  synthetic sequence
aactgtcacccca

SEQ ID NO: 90 - DNA, 13 bp, Artificial Sequence
  synthetic sequence
gatgcaagcacat

SEQ ID NO: 91 - DNA, 13 bp, Artificial Sequence
  synthetic sequence
ctgaatcatgcat

SEQ ID NO: 92 - DNA, 13 bp, Artificial Sequence
  synthetic sequence
atatgctttggga

SEQ ID NO: 93 - DNA, 13 bp, Artificial Sequence
  synthetic sequence
agtggggacatgg

SEQ ID NO: 94 - DNA, 13 bp, Artificial Sequence
  synthetic sequence
agcagcagtgtga

SEQ ID NO: 95 - DNA, 13 bp, Artificial Sequence
  synthetic sequence
caaggtcatttat

SEQ ID NO: 96 - DNA, 13 bp, Artificial Sequence
  synthetic sequence
ttgagccttcaaa

SEQ ID NO: 97 - DNA, 13 bp, Artificial Sequence
  synthetic sequence
aaacttgggtttt

SEQ ID NO: 98 - DNA, 13 bp, Artificial Sequence
  synthetic sequence
ctttctatttgaa

SEQ ID NO: 99 - DNA, 13 bp, Artificial Sequence
  synthetic sequence
agatgaacaggag

SEQ ID NO: 100 - DNA, 13 bp, Artificial Sequence
  synthetic sequence
taaaatatcccac

SEQ ID NO: 101 - DNA, 13 bp, Artificial Sequence
  synthetic sequence
agcatctctgaag

SEQ ID NO: 102 - DNA, 13 bp, Artificial Sequence
  synthetic sequence
cctgatgacacct

SEQ ID NO: 103 - DNA, 13 bp, Artificial Sequence
  synthetic sequence
aaccttcagttct

SEQ ID NO: 104 - DNA, 13 bp, Artificial Sequence
  synthetic sequence
actcacctacaga

SEQ ID NO: 105 - DNA, 13 bp, Artificial Sequence
  synthetic sequence
tgtttacagctgt

SEQ ID NO: 106 - DNA, 13 bp, Artificial Sequence
  synthetic sequence
accatctagatgt

SEQ ID NO: 107 - DNA, 13 bp, Artificial Sequence
  synthetic sequence
cacaacatcaaac

SEQ ID NO: 108 - DNA, 13 bp, Artificial Sequence
  synthetic sequence
ctatcgtgatagt

SEQ ID NO: 109 - DNA, 13 bp, Artificial Sequence
  synthetic sequence
ttgcaaactgcta

SEQ ID NO: 110 - DNA, 13 bp, Artificial Sequence
  synthetic sequence
gtgttcactttga

SEQ ID NO: 111 - DNA, 13 bp, Artificial Sequence
  synthetic sequence
gaaacaaggcagc

SEQ ID NO: 112 - DNA, 13 bp, Artificial Sequence
  synthetic sequence
tagtgatgccata

SEQ ID NO: 113 - DNA, 13 bp, Artificial Sequence
  synthetic sequence
aaacgagattctg

SEQ ID NO: 114 - DNA, 13 bp, Artificial Sequence
  synthetic sequence
ctatccttaatgt

SEQ ID NO: 115 - DNA, 13 bp, Artificial Sequence
  synthetic sequence
aactagaaagctt

SEQ ID NO: 116 - DNA, 13 bp, Artificial Sequence
  synthetic sequence
aatatgacctctg

SEQ ID NO: 117 - DNA, 13 bp, Artificial Sequence
  synthetic sequence
ggaacttcttaaa

SEQ ID NO: 118 - DNA, 13 bp, Artificial Sequence
  synthetic sequence
actaccgtgacag

SEQ ID NO: 119 - DNA, 13 bp, Artificial Sequence
  synthetic sequence
aaggtctaactga

SEQ ID NO: 120 - DNA, 13 bp, Artificial Sequence
  synthetic sequence
atggaagtggaga

SEQ ID NO: 121 - DNA, 13 bp, Artificial Sequence
  synthetic sequence
caacttaaatctt

SEQ ID NO: 122 - DNA, 13 bp, Artificial Sequence
  synthetic sequence
cacagctcttaat

SEQ ID NO: 123 - DNA, 13 bp, Artificial Sequence
  synthetic sequence
cttctcctcaacg

SEQ ID NO: 124 - DNA, 13 bp, Artificial Sequence
  synthetic sequence
tgcttgaccatct

SEQ ID NO: 125 - DNA, 13 bp, Artificial Sequence
  synthetic sequence
ctagaaggtcact

SEQ ID NO: 126 - DNA, 13 bp, Artificial Sequence
  synthetic sequence
ttcaaggtgcaaa

SEQ ID NO: 127 - DNA, 13 bp, Artificial Sequence
  synthetic sequence
tcagacttggaac

SEQ ID NO: 128 - DNA, 13 bp, Artificial Sequence
  synthetic sequence
acagagagctcta

SEQ ID NO: 129 - DNA, 13 bp, Artificial Sequence
  synthetic sequence
agcattagccctg

SEQ ID NO: 130 - DNA, 13 bp, Artificial Sequence
  synthetic sequence
tgaagaggtacat

SEQ ID NO: 131 - DNA, 13 bp, Artificial Sequence
  synthetic sequence
gggttagcatctc

SEQ ID NO: 132 - DNA, 13 bp, Artificial Sequence
  synthetic sequence
cataacatcaaac

SEQ ID NO: 133 - DNA, 13 bp, Artificial Sequence
  synthetic sequence
agtgaagtatgct

SEQ ID NO: 134 - DNA, 13 bp, Artificial Sequence
  synthetic sequence
gcaacatggagct

SEQ ID NO: 135 - DNA, 13 bp, Artificial Sequence
  synthetic sequence
tgcactctggaca

SEQ ID NO: 136 - DNA, 13 bp, Artificial Sequence
  synthetic sequence
gatatttgagccc

SEQ ID NO: 137 - DNA, 13 bp, Artificial Sequence
  synthetic sequence
cacatgaggttta

SEQ ID NO: 138 - DNA, 13 bp, Artificial Sequence
  synthetic sequence
ctgagtcatgtat

SEQ ID NO: 139 - DNA, 13 bp, Artificial Sequence
  synthetic sequence
ctttgtgtgcttt

SEQ ID NO: 140 - DNA, 13 bp, Artificial Sequence
  synthetic sequence
tcaacaatgtgct

SEQ ID NO: 141 - DNA, 13 bp, Artificial Sequence
  synthetic sequence
ggtctgtttgcaa

SEQ ID NO: 142 - DNA, 13 bp, Artificial Sequence
  synthetic sequence
tcttcaacaagct

SEQ ID NO: 143 - DNA, 13 bp, Artificial Sequence
  synthetic sequence
actctgttctgac

SEQ ID NO: 144 - DNA, 13 bp, Artificial Sequence
  synthetic sequence
agtgacagaaagg

SEQ ID NO: 145 - DNA, 13 bp, Artificial Sequence
  synthetic sequence
agaagtaaggtca

SEQ ID NO: 146 - DNA, 13 bp, Artificial Sequence
  synthetic sequence
ctctctgatactg

SEQ ID NO: 147 - DNA, 13 bp, Artificial Sequence
  synthetic sequence
tcactctgatcaa

SEQ ID NO: 148 - DNA, 13 bp, Artificial Sequence
  synthetic sequence
aagacagtagcag

SEQ ID NO: 149 - DNA, 13 bp, Artificial Sequence
  synthetic sequence
tacggactacaag

SEQ ID NO: 150 - DNA, 13 bp, Artificial Sequence
  synthetic sequence
taagttaacattc

SEQ ID NO: 151 - DNA, 13 bp, Artificial Sequence
  synthetic sequence
gaagacatttcac

SEQ ID NO: 152 - DNA, 13 bp, Artificial Sequence
  synthetic sequence
tcttcagtgttaa

SEQ ID NO: 153 - DNA, 13 bp, Artificial Sequence
  synthetic sequence
attatggaaacag

SEQ ID NO: 154 - DNA, 13 bp, Artificial Sequence
  synthetic sequence
tgtcaggcatcga

SEQ ID NO: 155 - DNA, 13 bp, Artificial Sequence
  synthetic sequence
ctgaatcatgctc

SEQ ID NO: 156 - DNA, 13 bp, Artificial Sequence
  synthetic sequence
acctgcagacatc

SEQ ID NO: 157 - DNA, 13 bp, Artificial Sequence
  synthetic sequence
atgttgaagattt

SEQ ID NO: 158 - DNA, 13 bp, Artificial Sequence
  synthetic sequence
aacaaactctcta

SEQ ID NO: 159 - DNA, 13 bp, Artificial Sequence
  synthetic sequence
tcccttcagtgtt

SEQ ID NO: 160 - DNA, 13 bp, Artificial Sequence
  synthetic sequence
gggtttgtttgcc

SEQ ID NO: 161 - DNA, 13 bp, Artificial Sequence
  synthetic sequence
aggtgcagagcca

SEQ ID NO: 162 - DNA, 13 bp, Artificial Sequence
  synthetic sequence
aaccatttgaatt

SEQ ID NO: 163 - DNA, 13 bp, Artificial Sequence
  synthetic sequence
agagatgctgtca

SEQ ID NO: 164 - DNA, 13 bp, Artificial Sequence
  synthetic sequence
tgatatttagcga

SEQ ID NO: 165 - DNA, 13 bp, Artificial Sequence
  synthetic sequence
tgaactgagttct

SEQ ID NO: 166 - DNA, 13 bp, Artificial Sequence
  synthetic sequence
agttaacttctcg

SEQ ID NO: 167 - DNA, 13 bp, Artificial Sequence
  synthetic sequence
gttatctaaactg

SEQ ID NO: 168 - DNA, 13 bp, Artificial Sequence
  synthetic sequence
caatatactgctc

SEQ ID NO: 169 - DNA, 13 bp, Artificial Sequence
  synthetic sequence
tgaagcagcagca

SEQ ID NO: 170 - DNA, 13 bp, Artificial Sequence
  synthetic sequence
gaatgagcttttg

SEQ ID NO: 171 - DNA, 13 bp, Artificial Sequence
  synthetic sequence
ggaaatttagagt

SEQ ID NO: 172 - DNA, 13 bp, Artificial Sequence
  synthetic sequence
agctttagtagtg

SEQ ID NO: 173 - DNA, 13 bp, Artificial Sequence
  synthetic sequence
tgatgccgaaagt

SEQ ID NO: 174 - DNA, 13 bp, Artificial Sequence
  synthetic sequence
atcttcagttctc

SEQ ID NO: 175 - DNA, 13 bp, Artificial Sequence
  synthetic sequence
aaatatcctacag

SEQ ID NO: 176 - DNA, 13 bp, Artificial Sequence
  synthetic sequence
tgcgaaaactgtc

SEQ ID NO: 177 - DNA, 13 bp, Artificial Sequence
  synthetic sequence
agagacaagtact

SEQ ID NO: 178 - DNA, 13 bp, Artificial Sequence
  synthetic sequence
gccagccactgta

SEQ ID NO: 179 - DNA, 13 bp, Artificial Sequence
  synthetic sequence
ttcttcccttctg

SEQ ID NO: 180 - DNA, 13 bp, Artificial Sequence
  synthetic sequence
caacttcagacga

SEQ ID NO: 181 - DNA, 13 bp, Artificial Sequence
  synthetic sequence
gctaggaggtcat

SEQ ID NO: 182 - DNA, 13 bp, Artificial Sequence
  synthetic sequence
ttgcgattggcta

SEQ ID NO: 183 - DNA, 13 bp, Artificial Sequence
  synthetic sequence
ctgtttgacctga

SEQ ID NO: 184 - DNA, 13 bp, Artificial Sequence
  synthetic sequence
agcagtcaaaccc

SEQ ID NO: 185 - DNA, 13 bp, Artificial Sequence
  synthetic sequence
tgaaccctcaaag

SEQ ID NO: 186 - DNA, 13 bp, Artificial Sequence
  synthetic sequence
cccagtgatgcca

SEQ ID NO: 187 - DNA, 13 bp, Artificial Sequence
  synthetic sequence
tgacaggcaggtc

SEQ ID NO: 188 - DNA, 13 bp, Artificial Sequence
  synthetic sequence
gatcactcatatc

SEQ ID NO: 189 - DNA, 13 bp, Artificial Sequence
  synthetic sequence
cagtacgtaagtg

SEQ ID NO: 190 - DNA, 13 bp, Artificial Sequence
  synthetic sequence
agagttgcacaca

SEQ ID NO: 191 - DNA, 13 bp, Artificial Sequence
  synthetic sequence
actgcaaacatag

SEQ ID NO: 192 - DNA, 13 bp, Artificial Sequence
  synthetic sequence
aacattgaaactg

SEQ ID NO: 193 - DNA, 13 bp, Artificial Sequence
  synthetic sequence
actgcatatcaag

SEQ ID NO: 194 - DNA, 13 bp, Artificial Sequence
  synthetic sequence
ggtgtaagagaaa

SEQ ID NO: 195 - DNA, 13 bp, Artificial Sequence
  synthetic sequence
tctgccaaatgtt

SEQ ID NO: 196 - DNA, 13 bp, Artificial Sequence
  synthetic sequence
atgaaccagatga

SEQ ID NO: 197 - DNA, 13 bp, Artificial Sequence
  synthetic sequence
gacacctcaaaga

SEQ ID NO: 198 - DNA, 13 bp, Artificial Sequence
  synthetic sequence
gtgaggcttcctc

SEQ ID NO: 199 - DNA, 13 bp, Artificial Sequence
  synthetic sequence
ataattggaaagc

SEQ ID NO: 200 - DNA, 13 bp, Artificial Sequence
  synthetic sequence
catatcagaccag

SEQ ID NO: 201 - DNA, 13 bp, Artificial Sequence
  synthetic sequence
ggcatgtgacaca

SEQ ID NO: 202 - DNA, 13 bp, Artificial Sequence
  synthetic sequence
agagaaattcacc

SEQ ID NO: 203 - DNA, 13 bp, Artificial Sequence
  synthetic sequence
gggccacgtaaaa

SEQ ID NO: 204 - DNA, 13 bp, Artificial Sequence
  synthetic sequence
ctcttctggttca

SEQ ID NO: 205 - DNA, 13 bp, Artificial Sequence
  synthetic sequence
tggaaggttgaat

SEQ ID NO: 206 - DNA, 13 bp, Artificial Sequence
  synthetic sequence
acctgacaaattt

SEQ ID NO: 207 - DNA, 13 bp, Artificial Sequence
  synthetic sequence
agtacttatcagg

SEQ ID NO: 208 - DNA, 13 bp, Artificial Sequence
  synthetic sequence
cctcagcacagcc

SEQ ID NO: 209 - DNA, 13 bp, Artificial Sequence
  synthetic sequence
aggggccatgtga

SEQ ID NO: 210 - DNA, 13 bp, Artificial Sequence
  synthetic sequence
agtccatccagca

SEQ ID NO: 211 - DNA, 13 bp, Artificial Sequence
  synthetic sequence
ttcatgtagatga

SEQ ID NO: 212 - DNA, 13 bp, Artificial Sequence
  synthetic sequence
gaagacctaacaa

SEQ ID NO: 213 - DNA, 13 bp, Artificial Sequence
  synthetic sequence
tgcacttgagcat

SEQ ID NO: 214 - DNA, 13 bp, Artificial Sequence
  synthetic sequence
gaagaatggccca

SEQ ID NO: 215 - DNA, 13 bp, Artificial Sequence
  synthetic sequence
gcatcaagattga

SEQ ID NO: 216 - DNA, 13 bp, Artificial Sequence
  synthetic sequence
tcttttggttcag

SEQ ID NO: 217 - DNA, 13 bp, Artificial Sequence
  synthetic sequence
cagaggccatagt

SEQ ID NO: 218 - DNA, 13 bp, Artificial Sequence
  synthetic sequence
taatcggaaagca

SEQ ID NO: 219 - DNA, 13 bp, Artificial Sequence
  synthetic sequence
tggattgtgcttc

SEQ ID NO: 220 - DNA, 13 bp, Artificial Sequence
  synthetic sequence
tgcaagagaaatc

SEQ ID NO: 221 - DNA, 13 bp, Artificial Sequence
  synthetic sequence
aagccacccgcga

SEQ ID NO: 222 - DNA, 13 bp, Artificial Sequence
  synthetic sequence
acaagtagaagag

SEQ ID NO: 223 - DNA, 13 bp, Artificial Sequence
  synthetic sequence
catctcaaagacg

SEQ ID NO: 224 - DNA, 13 bp, Artificial Sequence
  synthetic sequence
ctgtcacaccgga

SEQ ID NO: 225 - DNA, 13 bp, Artificial Sequence
  synthetic sequence
agcacagccccac

SEQ ID NO: 226 - DNA, 13 bp, Artificial Sequence
  synthetic sequence
tattgaggacaga

SEQ ID NO: 227 - DNA, 13 bp, Artificial Sequence
  synthetic sequence
caagtatttgcct

SEQ ID NO: 228 - DNA, 13 bp, Artificial Sequence
  synthetic sequence
aacatctaattca

SEQ ID NO: 229 - DNA, 13 bp, Artificial Sequence
  synthetic sequence
gtctgcccagcag

SEQ ID NO: 230 - DNA, 13 bp, Artificial Sequence
  synthetic sequence
cacaacaccaccg

SEQ ID NO: 231 - DNA, 13 bp, Artificial Sequence
  synthetic sequence
ttgagactgatta

SEQ ID NO: 232 - DNA, 13 bp, Artificial Sequence
  synthetic sequence
tttaaaccaacag

SEQ ID NO: 233 - DNA, 13 bp, Artificial Sequence
  synthetic sequence
agacactgacgga

SEQ ID NO: 234 - DNA, 13 bp, Artificial Sequence
  synthetic sequence
tttctcttttggt

SEQ ID NO: 235 - DNA, 13 bp, Artificial Sequence
  synthetic sequence
tcccaccaacgtc

SEQ ID NO: 236 - DNA, 13 bp, Artificial Sequence
  synthetic sequence
ggggcgattaggc

SEQ ID NO: 237 - DNA, 13 bp, Artificial Sequence
  synthetic sequence
gactctgaaggct

SEQ ID NO: 238 - DNA, 13 bp, Artificial Sequence
  synthetic sequence
caatgactgcgtt

SEQ ID NO: 239 - DNA, 13 bp, Artificial Sequence
  synthetic sequence
aattgagcataag

SEQ ID NO: 240 - DNA, 13 bp, Artificial Sequence
  synthetic sequence
gcacgtcagtcac

SEQ ID NO: 241 - DNA, 13 bp, Artificial Sequence
  synthetic sequence
catcgaaactgat

SEQ ID NO: 242 - DNA, 13 bp, Artificial Sequence
  synthetic sequence
agctgtatgatct

SEQ ID NO: 243 - DNA, 13 bp, Artificial Sequence
  synthetic sequence
gctgcacacatgg

SEQ ID NO: 244 - DNA, 13 bp, Artificial Sequence
  synthetic sequence
gaagaagacctta

SEQ ID NO: 245 - DNA, 13 bp, Artificial Sequence
  synthetic sequence
tggaaagtggaat

SEQ ID NO: 246 - DNA, 13 bp, Artificial Sequence
  synthetic sequence
acttaaggatgaa

SEQ ID NO: 247 - DNA, 13 bp, Artificial Sequence
  synthetic sequence
ctggttcagtttt

SEQ ID NO: 248 - DNA, 13 bp, Artificial Sequence
  synthetic sequence
caggtgagagaaa

SEQ ID NO: 249 - DNA, 13 bp, Artificial Sequence
  synthetic sequence
ctagtgatgaagt

SEQ ID NO: 250 - DNA, 13 bp, Artificial Sequence
  synthetic sequence
cccaggcgatttg

SEQ ID NO: 251 - DNA, 13 bp, Artificial Sequence
  synthetic sequence
cagtacaacccaa

SEQ ID NO: 252 - DNA, 13 bp, Artificial Sequence
  synthetic sequence
tacttctctgcca

SEQ ID NO: 253 - DNA, 13 bp, Artificial Sequence
  synthetic sequence
aatgcatttgaat

SEQ ID NO: 254 - DNA, 13 bp, Artificial Sequence
  synthetic sequence
gttacccaagagc

SEQ ID NO: 255 - DNA, 13 bp, Artificial Sequence
  synthetic sequence
attcaagtacaga

SEQ ID NO: 256 - DNA, 13 bp, Artificial Sequence
  synthetic sequence
gaccatcaacaga

SEQ ID NO: 257 - DNA, 13 bp, Artificial Sequence
  synthetic sequence
tcaggtgacagac

SEQ ID NO: 258 - DNA, 13 bp, Artificial Sequence
  synthetic sequence
ttcagatggacta

SEQ ID NO: 259 - DNA, 13 bp, Artificial Sequence
  synthetic sequence
taacctcagatgg

SEQ ID NO: 260 - DNA, 13 bp, Artificial Sequence
  synthetic sequence
aacagtccgcaca

SEQ ID NO: 261 - DNA, 13 bp, Artificial Sequence
  synthetic sequence
ctccacaccaaca

SEQ ID NO: 262 - DNA, 13 bp, Artificial Sequence
  synthetic sequence
ccctcacaccgga

SEQ ID NO: 263 - DNA, 13 bp, Artificial Sequence
  synthetic sequence
actctttagacat

SEQ ID NO: 264 - DNA, 13 bp, Artificial Sequence
  synthetic sequence
acaacccgagccc

SEQ ID NO: 265 - DNA, 13 bp, Artificial Sequence
  synthetic sequence
aattgagacatac

SEQ ID NO: 266 - DNA, 13 bp, Artificial Sequence
  synthetic sequence
ccctagtgttagt

SEQ ID NO: 267 - DNA, 13 bp, Artificial Sequence
  synthetic sequence
acgcccacagtgt

SEQ ID NO: 268 - DNA, 13 bp, Artificial Sequence
  synthetic sequence
accaagtccattc

SEQ ID NO: 269 - DNA, 13 bp, Artificial Sequence
  synthetic sequence
caacaggccttgc

SEQ ID NO: 270 - DNA, 13 bp, Artificial Sequence
  synthetic sequence
tctcacagttcct

SEQ ID NO: 271 - DNA, 13 bp, Artificial Sequence
  synthetic sequence
ctggcgaaattgt

SEQ ID NO: 272 - DNA, 13 bp, Artificial Sequence
  synthetic sequence
atatacgagtgtg

SEQ ID NO: 273 - DNA, 13 bp, Artificial Sequence
  synthetic sequence
acccatatatgaa

SEQ ID NO: 274 - DNA, 13 bp, Artificial Sequence
  synthetic sequence
caaaatggaaaac

SEQ ID NO: 275 - DNA, 13 bp, Artificial Sequence
  synthetic sequence
aaagtccctggtg

SEQ ID NO: 276 - DNA, 13 bp, Artificial Sequence
  synthetic sequence
cgtgccgcttacg

SEQ ID NO: 277 - DNA, 13 bp, Artificial Sequence
  synthetic sequence
gactgtctcacag

SEQ ID NO: 278 - DNA, 13 bp, Artificial Sequence
  synthetic sequence
atcgaagtgacta

SEQ ID NO: 279 - DNA, 13 bp, Artificial Sequence
  synthetic sequence
agatgaacaaatg

SEQ ID NO: 280 - DNA, 13 bp, Artificial Sequence
  synthetic sequence
ccaagcttgcaga

SEQ ID NO: 281 - DNA, 13 bp, Artificial Sequence
  synthetic sequence
acaaggctggcgt

SEQ ID NO: 282 - DNA, 13 bp, Artificial Sequence
  synthetic sequence
tgatgatgctgct

SEQ ID NO: 283 - DNA, 13 bp, Artificial Sequence
  synthetic sequence
ggtccttgcagaa

SEQ ID NO: 284 - DNA, 13 bp, Artificial Sequence
  synthetic sequence
ggcatgtttccag

SEQ ID NO: 285 - DNA, 13 bp, Artificial Sequence
  synthetic sequence
aaaagagacagtt

SEQ ID NO: 286 - DNA, 13 bp, Artificial Sequence
  synthetic sequence
caacatcagtgtt

SEQ ID NO: 287 - DNA, 13 bp, Artificial Sequence
  synthetic sequence
tctgctgtttctt

SEQ ID NO: 288 - DNA, 13 bp, Artificial Sequence
  synthetic sequence
tttgctatcattt

SEQ ID NO: 289 - DNA, 13 bp, Artificial Sequence
  synthetic sequence
gaccaacagctga

SEQ ID NO: 290 - DNA, 13 bp, Artificial Sequence
  synthetic sequence
ttctactgaacat

SEQ ID NO: 291 - DNA, 13 bp, Artificial Sequence
  synthetic sequence
actttgagatgac

SEQ ID NO: 292 - DNA, 13 bp, Artificial Sequence
  synthetic sequence
aacaccaatctgg

SEQ ID NO: 293 - DNA, 13 bp, Artificial Sequence
  synthetic sequence
taatccaccatct

SEQ ID NO: 294 - DNA, 13 bp, Artificial Sequence
  synthetic sequence
ccacttcatcact

SEQ ID NO: 295 - DNA, 13 bp, Artificial Sequence
  synthetic sequence
ttgccttgtctat

SEQ ID NO: 296 - DNA, 13 bp, Artificial Sequence
  synthetic sequence
ctgccattctgct

SEQ ID NO: 297 - DNA, 13 bp, Artificial Sequence
  synthetic sequence
ctcttgcttgagc

SEQ ID NO: 298 - DNA, 13 bp, Artificial Sequence
  synthetic sequence
catcaatggagat

SEQ ID NO: 299 - DNA, 13 bp, Artificial Sequence
  synthetic sequence
aacttgtcctact

SEQ ID NO: 300 - DNA, 13 bp, Artificial Sequence
  synthetic sequence
tgtctttgaagaa

SEQ ID NO: 301 - DNA, 13 bp, Artificial Sequence
  synthetic sequence
tgacaagctcagc

SEQ ID NO: 302 - DNA, 13 bp, Artificial Sequence
  synthetic sequence
tgtacaccttctt

SEQ ID NO: 303 - DNA, 13 bp, Artificial Sequence
  synthetic sequence
agatggatgtgca

SEQ ID NO: 304 - DNA, 13 bp, Artificial Sequence
  synthetic sequence
cagctgccacttc

SEQ ID NO: 305 - DNA, 13 bp, Artificial Sequence
  synthetic sequence
ttgactcttctct

SEQ ID NO: 306 - DNA, 13 bp, Artificial Sequence
  synthetic sequence
gcaagtatattag

SEQ ID NO: 307 - DNA, 13 bp, Artificial Sequence
  synthetic sequence
actgctctaactg

SEQ ID NO: 308 - DNA, 13 bp, Artificial Sequence
  synthetic sequence
agtcctttgcgca

SEQ ID NO: 309 - DNA, 13 bp, Artificial Sequence
  synthetic sequence
tttattaagacct

SEQ ID NO: 310 - DNA, 13 bp, Artificial Sequence
  synthetic sequence
caatcttgcctgc

SEQ ID NO: 311 - DNA, 13 bp, Artificial Sequence
  synthetic sequence
aaataatgaaact

SEQ ID NO: 312 - DNA, 13 bp, Artificial Sequence
  synthetic sequence
tgctgagtagatc

SEQ ID NO: 313 - DNA, 13 bp, Artificial Sequence
  synthetic sequence
ttacactggttga

SEQ ID NO: 314 - DNA, 13 bp, Artificial Sequence
  synthetic sequence
acagaacactttg

SEQ ID NO: 315 - DNA, 13 bp, Artificial Sequence
  synthetic sequence
acatgtccttgag

SEQ ID NO: 316 - DNA, 13 bp, Artificial Sequence
  synthetic sequence
gtttgtctcgtgt

SEQ ID NO: 317 - DNA, 13 bp, Artificial Sequence
  synthetic sequence
ttatataggttgt

SEQ ID NO: 318 - DNA, 13 bp, Artificial Sequence
  synthetic sequence
tattggtgacaag

SEQ ID NO: 319 - DNA, 13 bp, Artificial Sequence
  synthetic sequence
tgtaagattcttc

SEQ ID NO: 320 - DNA, 13 bp, Artificial Sequence
  synthetic sequence
aaacagtggagca

SEQ ID NO: 321 - DNA, 13 bp, Artificial Sequence
  synthetic sequence
caactattcctct

SEQ ID NO: 322 - DNA, 13 bp, Artificial Sequence
  synthetic sequence
ttcgatacaaaca

SEQ ID NO: 323 - DNA, 13 bp, Artificial Sequence
  synthetic sequence
tttgagaagtcaa

SEQ ID NO: 324 - DNA, 13 bp, Artificial Sequence
  synthetic sequence
ctctctcctcagc

SEQ ID NO: 325 - DNA, 13 bp, Artificial Sequence
  synthetic sequence
tcatccaagcttg

SEQ ID NO: 326 - DNA, 13 bp, Artificial Sequence
  synthetic sequence
cctagctcattag

SEQ ID NO: 327 - DNA, 13 bp, Artificial Sequence
  synthetic sequence
aaataatcaaact

SEQ ID NO: 328 - DNA, 13 bp, Artificial Sequence
  synthetic sequence
atacaacataaca

SEQ ID NO: 329 - DNA, 13 bp, Artificial Sequence
  synthetic sequence
aagcagctcaatc

SEQ ID NO: 330 - DNA, 13 bp, Artificial Sequence
  synthetic sequence
acattgaaagaca

SEQ ID NO: 331 - DNA, 13 bp, Artificial Sequence
  synthetic sequence
ggcatgcttccaa

SEQ ID NO: 332 - DNA, 13 bp, Artificial Sequence
  synthetic sequence
aagcggtctttaa

SEQ ID NO: 333 - DNA, 13 bp, Artificial Sequence
  synthetic sequence
caatcttttctga

SEQ ID NO: 334 - DNA, 13 bp, Artificial Sequence
  synthetic sequence
aaacaatggagca

SEQ ID NO: 335 - DNA, 13 bp, Artificial Sequence
  synthetic sequence
gcttccaggctgt

SEQ ID NO: 336 - DNA, 13 bp, Artificial Sequence
  synthetic sequence
cttgtttcttaga

SEQ ID NO: 337 - DNA, 13 bp, Artificial Sequence
  synthetic sequence
tcatctttttgat

SEQ ID NO: 338 - DNA, 13 bp, Artificial Sequence
  synthetic sequence
attcttctacaac

SEQ ID NO: 339 - DNA, 13 bp, Artificial Sequence
  synthetic sequence
gacatgtctttga

SEQ ID NO: 340 - DNA, 13 bp, Artificial Sequence
  synthetic sequence
ggttgtgtgcata

SEQ ID NO: 341 - DNA, 13 bp, Artificial Sequence
  synthetic sequence
tttgtttgatggc

SEQ ID NO: 342 - DNA, 13 bp, Artificial Sequence
  synthetic sequence
ccttagtgaagct

SEQ ID NO: 343 - DNA, 13 bp, Artificial Sequence
  synthetic sequence
catctaccgtgct

SEQ ID NO: 344 - DNA, 13 bp, Artificial Sequence
  synthetic sequence
tttacgcattgcc

SEQ ID NO: 345 - DNA, 13 bp, Artificial Sequence
  synthetic sequence
gaaagaagaatgg

SEQ ID NO: 346 - DNA, 13 bp, Artificial Sequence
  synthetic sequence
ctgagcagacagt

SEQ ID NO: 347 - DNA, 13 bp, Artificial Sequence
  synthetic sequence
actgccttgcact

SEQ ID NO: 348 - DNA, 13 bp, Artificial Sequence
  synthetic sequence
gtgagttctttga

SEQ ID NO: 349 - DNA, 13 bp, Artificial Sequence
  synthetic sequence
tcatcaattttat

SEQ ID NO: 350 - DNA, 13 bp, Artificial Sequence
  synthetic sequence
acactattataca

SEQ ID NO: 351 - DNA, 13 bp, Artificial Sequence
  synthetic sequence
ctctctcctcagt

SEQ ID NO: 352 - DNA, 13 bp, Artificial Sequence
  synthetic sequence
tttgaaaggttct

SEQ ID NO: 353 - DNA, 13 bp, Artificial Sequence
  synthetic sequence
agatctgcacatt

SEQ ID NO: 354 - DNA, 13 bp, Artificial Sequence
  synthetic sequence
attcttctgcaac

SEQ ID NO: 355 - DNA, 13 bp, Artificial Sequence
  synthetic sequence
ccataagcccttt

SEQ ID NO: 356 - DNA, 13 bp, Artificial Sequence
  synthetic sequence
gctgccacttcct

SEQ ID NO: 357 - DNA, 13 bp, Artificial Sequence
  synthetic sequence
gcatcataccgga

SEQ ID NO: 358 - DNA, 13 bp, Artificial Sequence
  synthetic sequence
ccatcaaactcac

SEQ ID NO: 359 - DNA, 13 bp, Artificial Sequence
  synthetic sequence
tgtgcctatcaag

SEQ ID NO: 360 - DNA, 13 bp, Artificial Sequence
  synthetic sequence
taaaaccaaatct

SEQ ID NO: 361 - DNA, 13 bp, Artificial Sequence
  synthetic sequence
ctgacaagttcag

SEQ ID NO: 362 - DNA, 13 bp, Artificial Sequence
  synthetic sequence
tcaactattcccc

SEQ ID NO: 363 - DNA, 13 bp, Artificial Sequence
  synthetic sequence
tatctcgtgttag

SEQ ID NO: 364 - DNA, 13 bp, Artificial Sequence
  synthetic sequence
tatctgttaatga

SEQ ID NO: 365 - DNA, 13 bp, Artificial Sequence
  synthetic sequence
taccttcaagagc

SEQ ID NO: 366 - DNA, 13 bp, Artificial Sequence
  synthetic sequence
catggtataaatt

SEQ ID NO: 367 - DNA, 13 bp, Artificial Sequence
  synthetic sequence
tttactcattcca

SEQ ID NO: 368 - DNA, 13 bp, Artificial Sequence
  synthetic sequence
ttccattctagaa

SEQ ID NO: 369 - DNA, 13 bp, Artificial Sequence
  synthetic sequence
tctaccaaatata

SEQ ID NO: 370 - DNA, 13 bp, Artificial Sequence
  synthetic sequence
atttgcaatcatc

SEQ ID NO: 371 - DNA, 13 bp, Artificial Sequence
  synthetic sequence
agatcagttgaag

SEQ ID NO: 372 - DNA, 13 bp, Artificial Sequence
  synthetic sequence
taacattcaagga

SEQ ID NO: 373 - DNA, 13 bp, Artificial Sequence
  synthetic sequence
atgagtcctttgc

SEQ ID NO: 374 - DNA, 13 bp, Artificial Sequence
  synthetic sequence
cttgctcatgccg

SEQ ID NO: 375 - DNA, 13 bp, Artificial Sequence
  synthetic sequence
tctgcttgtcccg

SEQ ID NO: 376 - DNA, 13 bp, Artificial Sequence
  synthetic sequence
taaaacggacatg

SEQ ID NO: 377 - DNA, 13 bp, Artificial Sequence
  synthetic sequence
tccaatgtggtca

SEQ ID NO: 378 - DNA, 13 bp, Artificial Sequence
  synthetic sequence
tcattttcaaaga

SEQ ID NO: 379 - DNA, 13 bp, Artificial Sequence
  synthetic sequence
agtatggtgcaaa

SEQ ID NO: 380 - DNA, 13 bp, Artificial Sequence
  synthetic sequence
tgcagctaaaact

SEQ ID NO: 381 - DNA, 13 bp, Artificial Sequence
  synthetic sequence
tccatcaaattca

SEQ ID NO: 382 - DNA, 13 bp, Artificial Sequence
  synthetic sequence
cagctgagtggca

SEQ ID NO: 383 - DNA, 13 bp, Artificial Sequence
  synthetic sequence
aggcaatggactc

SEQ ID NO: 384 - DNA, 13 bp, Artificial Sequence
  synthetic sequence
catgactttagtc

SEQ ID NO: 385 - DNA, 13 bp, Artificial Sequence
  synthetic sequence
tctgcaagcgtgt

SEQ ID NO: 386 - DNA, 13 bp, Artificial Sequence
  synthetic sequence
ttttgatcttcac

SEQ ID NO: 387 - DNA, 13 bp, Artificial Sequence
  synthetic sequence
gctctctccttaa

SEQ ID NO: 388 - DNA, 13 bp, Artificial Sequence
  synthetic sequence
acagaacacttag

SEQ ID NO: 389 - DNA, 13 bp, Artificial Sequence
  synthetic sequence
caccatcgccaaa

SEQ ID NO: 390 - DNA, 13 bp, Artificial Sequence
  synthetic sequence
acctcatctagac

SEQ ID NO: 391 - DNA, 13 bp, Artificial Sequence
  synthetic sequence
atgcagtcagcct

SEQ ID NO: 392 - DNA, 13 bp, Artificial Sequence
  synthetic sequence
gattctgcttttg

SEQ ID NO: 393 - DNA, 13 bp, Artificial Sequence
  synthetic sequence
ccacagtactaag

SEQ ID NO: 394 - DNA, 13 bp, Artificial Sequence
  synthetic sequence
taatctttgaaag

SEQ ID NO: 395 - DNA, 13 bp, Artificial Sequence
  synthetic sequence
caagagggacact

SEQ ID NO: 396 - DNA, 13 bp, Artificial Sequence
  synthetic sequence
caactgactcaga

SEQ ID NO: 397 - DNA, 13 bp, Artificial Sequence
  synthetic sequence
tgctgtttcatca

SEQ ID NO: 398 - DNA, 13 bp, Artificial Sequence
  synthetic sequence
taacatattctct

SEQ ID NO: 399 - DNA, 13 bp, Artificial Sequence
  synthetic sequence
agctgtttagtgc

SEQ ID NO: 400 - DNA, 13 bp, Artificial Sequence
  synthetic sequence
ctaaccgcttccc

SEQ ID NO: 401 - DNA, 13 bp, Artificial Sequence
  synthetic sequence
taatccaccacct

SEQ ID NO: 402 - DNA, 13 bp, Artificial Sequence
  synthetic sequence
aaaatcaaccttg

SEQ ID NO: 403 - DNA, 13 bp, Artificial Sequence
  synthetic sequence
atttgtttgtctc

SEQ ID NO: 404 - DNA, 13 bp, Artificial Sequence
  synthetic sequence
tcacagacatgtg

SEQ ID NO: 405 - DNA, 13 bp, Artificial Sequence
  synthetic sequence
attgctccccatg

SEQ ID NO: 406 - DNA, 13 bp, Artificial Sequence
  synthetic sequence
tttccatctctac

SEQ ID NO: 407 - DNA, 13 bp, Artificial Sequence
  synthetic sequence
ggtgctgattgaa

SEQ ID NO: 408 - DNA, 13 bp, Artificial Sequence
  synthetic sequence
atttcagcatcta

SEQ ID NO: 409 - DNA, 13 bp, Artificial Sequence
  synthetic sequence
ctattgaaaggaa

SEQ ID NO: 410 - DNA, 13 bp, Artificial Sequence
  synthetic sequence
gctcaagttttgt

SEQ ID NO: 411 - DNA, 13 bp, Artificial Sequence
  synthetic sequence
gtgacaaatccat

SEQ ID NO: 412 - DNA, 13 bp, Artificial Sequence
  synthetic sequence
taaaaaggtcttt

SEQ ID NO: 413 - DNA, 13 bp, Artificial Sequence
  synthetic sequence
agatgccagagct

SEQ ID NO: 414 - DNA, 13 bp, Artificial Sequence
  synthetic sequence
ctacagtagcatt

SEQ ID NO: 415 - DNA, 13 bp, Artificial Sequence
  synthetic sequence
cttgcctgcactt

SEQ ID NO: 416 - DNA, 13 bp, Artificial Sequence
  synthetic sequence
gcagaagcttcag

SEQ ID NO: 417 - DNA, 13 bp, Artificial Sequence
  synthetic sequence
tcagtggagacct

SEQ ID NO: 418 - DNA, 13 bp, Artificial Sequence
  synthetic sequence
ttttgcacatgca

SEQ ID NO: 419 - DNA, 13 bp, Artificial Sequence
  synthetic sequence
tcctagagcctgt

SEQ ID NO: 420 - DNA, 13 bp, Artificial Sequence
  synthetic sequence
tgcaagaaggcca

SEQ ID NO: 421 - DNA, 13 bp, Artificial Sequence
  synthetic sequence
caaacataaagaa

SEQ ID NO: 422 - DNA, 13 bp, Artificial Sequence
  synthetic sequence
tttgtacatgcat

SEQ ID NO: 423 - DNA, 13 bp, Artificial Sequence
  synthetic sequence
ttctgttgagtta

SEQ ID NO: 424 - DNA, 13 bp, Artificial Sequence
  synthetic sequence
tgtaaatggccat

SEQ ID NO: 425 - DNA, 13 bp, Artificial Sequence
  synthetic sequence
ttgtctgtgcttg

SEQ ID NO: 426 - DNA, 13 bp, Artificial Sequence
  synthetic sequence
taagcagagctaa

SEQ ID NO: 427 - DNA, 13 bp, Artificial Sequence
  synthetic sequence
atcacttgcactt

SEQ ID NO: 428 - DNA, 13 bp, Artificial Sequence
  synthetic sequence
aacacttaaagca

SEQ ID NO: 429 - DNA, 13 bp, Artificial Sequence
  synthetic sequence
tctttcacatcta

SEQ ID NO: 430 - DNA, 13 bp, Artificial Sequence
  synthetic sequence
agtacatctgaga

SEQ ID NO: 431 - DNA, 13 bp, Artificial Sequence
  synthetic sequence
caacctgtgcaag

SEQ ID NO: 432 - DNA, 13 bp, Artificial Sequence
  synthetic sequence
tgtctatttcaca

SEQ ID NO: 433 - DNA, 13 bp, Artificial Sequence
  synthetic sequence
gatctagccaatg

SEQ ID NO: 434 - DNA, 13 bp, Artificial Sequence
  synthetic sequence
ataagggcatata

SEQ ID NO: 435 - DNA, 13 bp, Artificial Sequence
  synthetic sequence
gcaatcttctaga

SEQ ID NO: 436 - DNA, 13 bp, Artificial Sequence
  synthetic sequence
tctaaggtgagat

SEQ ID NO: 437 - DNA, 13 bp, Artificial Sequence
  synthetic sequence
cattttacctaat

SEQ ID NO: 438 - DNA, 13 bp, Artificial Sequence
  synthetic sequence
tgttaacacattt

SEQ ID NO: 439 - DNA, 13 bp, Artificial Sequence
  synthetic sequence
tcctgcagatata

SEQ ID NO: 440 - DNA, 13 bp, Artificial Sequence
  synthetic sequence
agaaccagttgat

SEQ ID NO: 441 - DNA, 13 bp, Artificial Sequence
  synthetic sequence
gtacaagaaggcc

SEQ ID NO: 442 - DNA, 13 bp, Artificial Sequence
  synthetic sequence
tgcaggaaggcca

SEQ ID NO: 443 - DNA, 13 bp, Artificial Sequence
  synthetic sequence
ccatgacagaaac

SEQ ID NO: 444 - DNA, 13 bp, Artificial Sequence
  synthetic sequence
taagggcaacaaa

SEQ ID NO: 445 - DNA, 13 bp, Artificial Sequence
  synthetic sequence
tgcctcaattgat

SEQ ID NO: 446 - DNA, 13 bp, Artificial Sequence
  synthetic sequence
ctccagtatatgt

SEQ ID NO: 447 - DNA, 13 bp, Artificial Sequence
  synthetic sequence
gatctgaaaggca

SEQ ID NO: 448 - DNA, 13 bp, Artificial Sequence
  synthetic sequence
cagtaaggacaac

SEQ ID NO: 449 - DNA, 13 bp, Artificial Sequence
  synthetic sequence
gcctgagcacctt

SEQ ID NO: 450 - DNA, 13 bp, Artificial Sequence
  synthetic sequence
aggggttggtggt

SEQ ID NO: 451 - DNA, 13 bp, Artificial Sequence
  synthetic sequence
tccgtgaaaaggt

SEQ ID NO: 452 - DNA, 13 bp, Artificial Sequence
  synthetic sequence
taaatagagcaaa

SEQ ID NO: 453 - DNA, 13 bp, Artificial Sequence
  synthetic sequence
tcagacttgcaaa

SEQ ID NO: 454 - DNA, 13 bp, Artificial Sequence
  synthetic sequence
tgcttgtggcggt

SEQ ID NO: 455 - DNA, 13 bp, Artificial Sequence
  synthetic sequence
agatgtagcatat

SEQ ID NO: 456 - DNA, 13 bp, Artificial Sequence
  synthetic sequence
tgtcgacagcaga

SEQ ID NO: 457 - DNA, 13 bp, Artificial Sequence
  synthetic sequence
tggaacattttta

SEQ ID NO: 458 - DNA, 13 bp, Artificial Sequence
  synthetic sequence
tcttgagcccatg

SEQ ID NO: 459 - DNA, 13 bp, Artificial Sequence
  synthetic sequence
tggcagctggtct

SEQ ID NO: 460 - DNA, 13 bp, Artificial Sequence
  synthetic sequence
ttgattgcaacat

SEQ ID NO: 461 - DNA, 13 bp, Artificial Sequence
  synthetic sequence
aagctacaatagc

SEQ ID NO: 462 - DNA, 13 bp, Artificial Sequence
  synthetic sequence
tctgagtgtcatc

SEQ ID NO: 463 - DNA, 13 bp, Artificial Sequence
  synthetic sequence
aacagaagcctcc

SEQ ID NO: 464 - DNA, 13 bp, Artificial Sequence
  synthetic sequence
atgaaactactag

SEQ ID NO: 465 - DNA, 13 bp, Artificial Sequence
  synthetic sequence
actatcgatctca

SEQ ID NO: 466 - DNA, 13 bp, Artificial Sequence
  synthetic sequence
cgtgttgttctca

SEQ ID NO: 467 - DNA, 13 bp, Artificial Sequence
  synthetic sequence
ccggtgacaatga

SEQ ID NO: 468 - DNA, 13 bp, Artificial Sequence
  synthetic sequence
caatattttgctg

SEQ ID NO: 469 - DNA, 13 bp, Artificial Sequence
  synthetic sequence
ttcagctgttggt

SEQ ID NO: 470 - DNA, 13 bp, Artificial Sequence
  synthetic sequence
tagccattttgcc

SEQ ID NO: 471 - DNA, 13 bp, Artificial Sequence
  synthetic sequence
gatttaaagggtt

SEQ ID NO: 472 - DNA, 13 bp, Artificial Sequence
  synthetic sequence
gcttgtgcttgat

SEQ ID NO: 473 - DNA, 13 bp, Artificial Sequence
  synthetic sequence
tccatccaaacat

SEQ ID NO: 474 - DNA, 13 bp, Artificial Sequence
  synthetic sequence
gtatcttaccgta

SEQ ID NO: 475 - DNA, 13 bp, Artificial Sequence
  synthetic sequence
atatgcagttccc

SEQ ID NO: 476 - DNA, 13 bp, Artificial Sequence
  synthetic sequence
gttgtaactgcaa

SEQ ID NO: 477 - DNA, 13 bp, Artificial Sequence
  synthetic sequence
cacagccctttaa

SEQ ID NO: 478 - DNA, 13 bp, Artificial Sequence
  synthetic sequence
aagcagacaccca

SEQ ID NO: 479 - DNA, 13 bp, Artificial Sequence
  synthetic sequence
caagtgctattcc

SEQ ID NO: 480 - DNA, 13 bp, Artificial Sequence
  synthetic sequence
caatctgtgcacc

SEQ ID NO: 481 - DNA, 13 bp, Artificial Sequence
  synthetic sequence
tttgcattgacac

SEQ ID NO: 482 - DNA, 13 bp, Artificial Sequence
  synthetic sequence
tgttggcactggt

SEQ ID NO: 483 - DNA, 13 bp, Artificial Sequence
  synthetic sequence
cttgtagcgttgc

SEQ ID NO: 484 - DNA, 13 bp, Artificial Sequence
  synthetic sequence
ctatgtcctttct

SEQ ID NO: 485 - DNA, 13 bp, Artificial Sequence
  synthetic sequence
cgcgcagcccttt

SEQ ID NO: 486 - DNA, 13 bp, Artificial Sequence
  synthetic sequence
ttgacacggaaac

SEQ ID NO: 487 - DNA, 13 bp, Artificial Sequence
  synthetic sequence
atgttagcactgg

SEQ ID NO: 488 - DNA, 13 bp, Artificial Sequence
  synthetic sequence
gtcaatctgagca

SEQ ID NO: 489 - DNA, 13 bp, Artificial Sequence
  synthetic sequence
acaagcgctatcc

SEQ ID NO: 490 - DNA, 13 bp, Artificial Sequence
  synthetic sequence
ttgaaggccctgc

SEQ ID NO: 491 - DNA, 13 bp, Artificial Sequence
  synthetic sequence
cccagctgatctc

SEQ ID NO: 492 - DNA, 13 bp, Artificial Sequence
  synthetic sequence
acacacggtctac

SEQ ID NO: 493 - DNA, 13 bp, Artificial Sequence
  synthetic sequence
atttgtgatcaaa

SEQ ID NO: 494 - DNA, 13 bp, Artificial Sequence
  synthetic sequence
acaaccccgttca

SEQ ID NO: 495 - DNA, 13 bp, Artificial Sequence
  synthetic sequence
actctcaggcacc

SEQ ID NO: 496 - DNA, 13 bp, Artificial Sequence
  synthetic sequence
aagctcagaggac

SEQ ID NO: 497 - DNA, 13 bp, Artificial Sequence
  synthetic sequence
agatcatagatgc

SEQ ID NO: 498 - DNA, 13 bp, Artificial Sequence
  synthetic sequence
acgatgaagagtg

SEQ ID NO: 499 - DNA, 13 bp, Artificial Sequence
  synthetic sequence
atcttcgacaaca

SEQ ID NO: 500 - DNA, 13 bp, Artificial Sequence
  synthetic sequence
catgccgtcacag

SEQ ID NO: 501 - DNA, 13 bp, Artificial Sequence
  synthetic sequence
taaccagaaaagg

SEQ ID NO: 502 - DNA, 13 bp, Artificial Sequence
  synthetic sequence
caggcggtgtaca

SEQ ID NO: 503 - DNA, 13 bp, Artificial Sequence
  synthetic sequence
gggcaggtgggta

SEQ ID NO: 504 - DNA, 13 bp, Artificial Sequence
  synthetic sequence
tcggtgcccacac

SEQ ID NO: 505 - DNA, 13 bp, Artificial Sequence
  synthetic sequence
tgcaccctgacag

SEQ ID NO: 506 - DNA, 13 bp, Artificial Sequence
  synthetic sequence
tgatagaggctgc

SEQ ID NO: 507 - DNA, 13 bp, Artificial Sequence
  synthetic sequence
caccgacgtgatg

SEQ ID NO: 508 - DNA, 13 bp, Artificial Sequence
  synthetic sequence
acaaagtaatgaa

SEQ ID NO: 509 - DNA, 13 bp, Artificial Sequence
  synthetic sequence
gtcgaagcgtacg

SEQ ID NO: 510 - DNA, 13 bp, Artificial Sequence
  synthetic sequence
cccgagagactcg

SEQ ID NO: 511 - DNA, 13 bp, Artificial Sequence
  synthetic sequence
tgatcagagcata

SEQ ID NO: 512 - DNA, 13 bp, Artificial Sequence
  synthetic sequence
agaaggaagaagc

SEQ ID NO: 513 - DNA, 13 bp, Artificial Sequence
  synthetic sequence
atgtgcatgtgtg

SEQ ID NO: 514 - DNA, 13 bp, Artificial Sequence
  synthetic sequence
acagctgtaaggt

SEQ ID NO: 515 - DNA, 13 bp, Artificial Sequence
  synthetic sequence
gggtatatcagtt

SEQ ID NO: 516 - DNA, 13 bp, Artificial Sequence
  synthetic sequence
gacgggtcggaga

SEQ ID NO: 517 - DNA, 13 bp, Artificial Sequence
  synthetic sequence
atgggagaagaac

SEQ ID NO: 518 - DNA, 13 bp, Artificial Sequence
  synthetic sequence
actgcctactaag

SEQ ID NO: 519 - DNA, 13 bp, Artificial Sequence
  synthetic sequence
cgaccgcagcacg

SEQ ID NO: 520 - DNA, 13 bp, Artificial Sequence
  synthetic sequence
actgggaagaatt

SEQ ID NO: 521 - DNA, 13 bp, Artificial Sequence
  synthetic sequence
gctgcctatcgag

SEQ ID NO: 522 - DNA, 13 bp, Artificial Sequence
  synthetic sequence
tgattaataactg

SEQ ID NO: 523 - DNA, 13 bp, Artificial Sequence
  synthetic sequence
catcggtgttcca

SEQ ID NO: 524 - DNA, 13 bp, Artificial Sequence
  synthetic sequence
attaaatatgcag

SEQ ID NO: 525 - DNA, 13 bp, Artificial Sequence
  synthetic sequence
ttgcggccgtgtc

SEQ ID NO: 526 - DNA, 13 bp, Artificial Sequence
  synthetic sequence
caggcagcacagg

SEQ ID NO: 527 - DNA, 13 bp, Artificial Sequence
  synthetic sequence
agaaacagcggag

SEQ ID NO: 528 - DNA, 13 bp, Artificial Sequence
  synthetic sequence
gaataaagacgga

SEQ ID NO: 529 - DNA, 13 bp, Artificial Sequence
  synthetic sequence
aagccaacgtttg

SEQ ID NO: 530 - DNA, 13 bp, Artificial Sequence
  synthetic sequence
gcatcatctcccc

SEQ ID NO: 531 - DNA, 13 bp, Artificial Sequence
  synthetic sequence
cagagactaaaga

SEQ ID NO: 532 - DNA, 13 bp, Artificial Sequence
  synthetic sequence
gacaacgtcatga

SEQ ID NO: 533 - DNA, 13 bp, Artificial Sequence
  synthetic sequence
agagctggttagg

SEQ ID NO: 534 - DNA, 13 bp, Artificial Sequence
  synthetic sequence
cacgtcactgacg

SEQ ID NO: 535 - DNA, 13 bp, Artificial Sequence
  synthetic sequence
aataggcctggag

SEQ ID NO: 536 - DNA, 13 bp, Artificial Sequence
  synthetic sequence
aagatgttcggat

SEQ ID NO: 537 - DNA, 13 bp, Artificial Sequence
  synthetic sequence
gttaggagattga

SEQ ID NO: 538 - DNA, 13 bp, Artificial Sequence
  synthetic sequence
cttgcgcatgctt

SEQ ID NO: 539 - DNA, 13 bp, Artificial Sequence
  synthetic sequence
atgaaagcaacaa

SEQ ID NO: 540 - DNA, 13 bp, Artificial Sequence
  synthetic sequence
agtttgatctaag

SEQ ID NO: 541 - DNA, 13 bp, Artificial Sequence
  synthetic sequence
gccgttatgccat

SEQ ID NO: 542 - DNA, 13 bp, Artificial Sequence
  synthetic sequence
acaggcggcacag

SEQ ID NO: 543 - DNA, 13 bp, Artificial Sequence
  synthetic sequence
agcagagtgcaag

SEQ ID NO: 544 - DNA, 13 bp, Artificial Sequence
  synthetic sequence
ataacgactgaga

SEQ ID NO: 545 - DNA, 13 bp, Artificial Sequence
  synthetic sequence
catgtgctcctgg

SEQ ID NO: 546 - DNA, 13 bp, Artificial Sequence
  synthetic sequence
aggtatgaagtgc

SEQ ID NO: 547 - DNA, 13 bp, Artificial Sequence
  synthetic sequence
agccacgattgga

SEQ ID NO: 548 - DNA, 13 bp, Artificial Sequence
  synthetic sequence
acacgttccagaa

SEQ ID NO: 549 - DNA, 13 bp, Artificial Sequence
  synthetic sequence
cacgaggagtggg

SEQ ID NO: 550 - DNA, 13 bp, Artificial Sequence
  synthetic sequence
aagaccctgagag

SEQ ID NO: 551 - DNA, 13 bp, Artificial Sequence
  synthetic sequence
tttcggctgtgtc

SEQ ID NO: 552 - DNA, 13 bp, Artificial Sequence
  synthetic sequence
tgatcagggcata

SEQ ID NO: 553 - DNA, 13 bp, Artificial Sequence
  synthetic sequence
ccgtaagcttctt

SEQ ID NO: 554 - DNA, 13 bp, Artificial Sequence
  synthetic sequence
cttgaccgggcga

SEQ ID NO: 555 - DNA, 13 bp, Artificial Sequence
  synthetic sequence
gtacgcggtcgaa

SEQ ID NO: 556 - DNA, 13 bp, Artificial Sequence
  synthetic sequence
gaggaggcagccg

SEQ ID NO: 557 - DNA, 13 bp, Artificial Sequence
  synthetic sequence
agctagcaagaaa

SEQ ID NO: 558 - DNA, 13 bp, Artificial Sequence
  synthetic sequence
cacctgtgatagg

SEQ ID NO: 559 - DNA, 13 bp, Artificial Sequence
  synthetic sequence
gagatacgcgata

SEQ ID NO: 560 - DNA, 13 bp, Artificial Sequence
  synthetic sequence
agtcactaatcac

SEQ ID NO: 561 - DNA, 13 bp, Artificial Sequence
  synthetic sequence
cacagagagttgg

SEQ ID NO: 562 - DNA, 13 bp, Artificial Sequence
  synthetic sequence
ggcgcagatgcat

SEQ ID NO: 563 - DNA, 13 bp, Artificial Sequence
  synthetic sequence
gtgactagactag

SEQ ID NO: 564 - DNA, 13 bp, Artificial Sequence
  synthetic sequence
tggtgggggataa

SEQ ID NO: 565 - DNA, 13 bp, Artificial Sequence
  synthetic sequence
tgggctaagagct

SEQ ID NO: 566 - DNA, 13 bp, Artificial Sequence
  synthetic sequence
ttcgacctaagcg

SEQ ID NO: 567 - DNA, 13 bp, Artificial Sequence
  synthetic sequence
ccgtgcctttgcc

SEQ ID NO: 568 - DNA, 13 bp, Artificial Sequence
  synthetic sequence
ggagagatttcca

SEQ ID NO: 569 - DNA, 13 bp, Artificial Sequence
  synthetic sequence
ccatgattggacc

SEQ ID NO: 570 - DNA, 13 bp, Artificial Sequence
  synthetic sequence
gacagcgcctttt

SEQ ID NO: 571 - DNA, 13 bp, Artificial Sequence
  synthetic sequence
gagatatctgcac

SEQ ID NO: 572 - DNA, 13 bp, Artificial Sequence
  synthetic sequence
ggacgacgagtta

SEQ ID NO: 573 - DNA, 13 bp, Artificial Sequence
  synthetic sequence
aagtatctccagg

SEQ ID NO: 574 - DNA, 13 bp, Artificial Sequence
  synthetic sequence
acaaccagtccca

SEQ ID NO: 575 - DNA, 13 bp, Artificial Sequence
  synthetic sequence
tgcatcatattga

SEQ ID NO: 576 - DNA, 13 bp, Artificial Sequence
  synthetic sequence
ctgttcgttgcca

SEQ ID NO: 577 - DNA, 13 bp, Artificial Sequence
  synthetic sequence
ctgctgtcatgac

SEQ ID NO: 578 - DNA, 13 bp, Artificial Sequence
  synthetic sequence
ctttaatcgcctg

SEQ ID NO: 579 - DNA, 13 bp, Artificial Sequence
  synthetic sequence
ttccttggtaaag

SEQ ID NO: 580 - DNA, 13 bp, Artificial Sequence
  synthetic sequence
cgctagccatggg

SEQ ID NO: 581 - DNA, 13 bp, Artificial Sequence
  synthetic sequence
ggcagttttcttt

SEQ ID NO: 582 - DNA, 13 bp, Artificial Sequence
  synthetic sequence
caaaggtggccat

SEQ ID NO: 583 - DNA, 13 bp, Artificial Sequence
  synthetic sequence
attcccttggact

SEQ ID NO: 584 - DNA, 13 bp, Artificial Sequence
  synthetic sequence
tttcgtagcagca

SEQ ID NO: 585 - DNA, 13 bp, Artificial Sequence
  synthetic sequence
gcttgacttcgaa

SEQ ID NO: 586 - DNA, 13 bp, Artificial Sequence
  synthetic sequence
tggtcaggataca

SEQ ID NO: 587 - DNA, 13 bp, Artificial Sequence
  synthetic sequence
atactttccccca

SEQ ID NO: 588 - DNA, 13 bp, Artificial Sequence
  synthetic sequence
acgtggaccagtc

SEQ ID NO: 589 - DNA, 13 bp, Artificial Sequence
  synthetic sequence
ctgagcttctggc

SEQ ID NO: 590 - DNA, 13 bp, Artificial Sequence
  synthetic sequence
gagaacagcacac

SEQ ID NO: 591 - DNA, 13 bp, Artificial Sequence
  synthetic sequence
tgctcatccagca

SEQ ID NO: 592 - DNA, 13 bp, Artificial Sequence
  synthetic sequence
acactccacgttg

SEQ ID NO: 593 - DNA, 13 bp, Artificial Sequence
  synthetic sequence
tttccccttttac

SEQ ID NO: 594 - DNA, 13 bp, Artificial Sequence
  synthetic sequence
gcatttgcagttt

SEQ ID NO: 595 - DNA, 13 bp, Artificial Sequence
  synthetic sequence
tctctgccctcac

SEQ ID NO: 596 - DNA, 13 bp, Artificial Sequence
  synthetic sequence
tgctccacctccc

SEQ ID NO: 597 - DNA, 13 bp, Artificial Sequence
  synthetic sequence
gcctgtataacct

SEQ ID NO: 598 - DNA, 13 bp, Artificial Sequence
  synthetic sequence
catcctgctcggg

SEQ ID NO: 599 - DNA, 13 bp, Artificial Sequence
  synthetic sequence
gttctttctctga

SEQ ID NO: 600 - DNA, 13 bp, Artificial Sequence
  synthetic sequence
ggtgaaatgggtg

SEQ ID NO: 601 - DNA, 13 bp, Artificial Sequence
  synthetic sequence
ctcctgagtactg

SEQ ID NO: 602 - DNA, 13 bp, Artificial Sequence
  synthetic sequence
cacgtacggagac

SEQ ID NO: 603 - DNA, 13 bp, Artificial Sequence
  synthetic sequence
catctggctgcca

SEQ ID NO: 604 - DNA, 13 bp, Artificial Sequence
  synthetic sequence
aatcagggctgcc

SEQ ID NO: 605 - DNA, 13 bp, Artificial Sequence
  synthetic sequence
atgcatcatactc

SEQ ID NO: 606 - DNA, 13 bp, Artificial Sequence
  synthetic sequence
ccgtctgtcgctt

SEQ ID NO: 607 - DNA, 13 bp, Artificial Sequence
  synthetic sequence
cacaccgagaatg

SEQ ID NO: 608 - DNA, 13 bp, Artificial Sequence
  synthetic sequence
gcgtaatacacag

SEQ ID NO: 609 - DNA, 13 bp, Artificial Sequence
  synthetic sequence
gtgacgccgggta

SEQ ID NO: 610 - DNA, 13 bp, Artificial Sequence
  synthetic sequence
cggtctctgcagt

SEQ ID NO: 611 - DNA, 13 bp, Artificial Sequence
  synthetic sequence
tgggtgcaggctg

SEQ ID NO: 612 - DNA, 13 bp, Artificial Sequence
  synthetic sequence
gagaagtttggtc

SEQ ID NO: 613 - DNA, 13 bp, Artificial Sequence
  synthetic sequence
tgatacctgcttc

SEQ ID NO: 614 - DNA, 13 bp, Artificial Sequence
  synthetic sequence
ccccgtcgtctag

SEQ ID NO: 615 - DNA, 13 bp, Artificial Sequence
  synthetic sequence
gacaggagtatga

SEQ ID NO: 616 - DNA, 13 bp, Artificial Sequence
  synthetic sequence
agggagtgatcca

SEQ ID NO: 617 - DNA, 13 bp, Artificial Sequence
  synthetic sequence
caccgcaattaca

SEQ ID NO: 618 - DNA, 13 bp, Artificial Sequence
  synthetic sequence
gcggtctgggcct

SEQ ID NO: 619 - DNA, 13 bp, Artificial Sequence
  synthetic sequence
ttcctttgcggac

SEQ ID NO: 620 - DNA, 13 bp, Artificial Sequence
  synthetic sequence
agtggttaatcct

SEQ ID NO: 621 - DNA, 13 bp, Artificial Sequence
  synthetic sequence
tctgcttcttttt

SEQ ID NO: 622 - DNA, 13 bp, Artificial Sequence
  synthetic sequence
agtgatccactcc

SEQ ID NO: 623 - DNA, 13 bp, Artificial Sequence
  synthetic sequence
acgaacgaggcca

SEQ ID NO: 624 - DNA, 13 bp, Artificial Sequence
  synthetic sequence
cagcaacagcaac

SEQ ID NO: 625 - DNA, 13 bp, Artificial Sequence
  synthetic sequence
ggtacctgcttct

SEQ ID NO: 626 - DNA, 13 bp, Artificial Sequence
  synthetic sequence
gctggttctaggg

SEQ ID NO: 627 - DNA, 13 bp, Artificial Sequence
  synthetic sequence
acgcccccaaagt

SEQ ID NO: 628 - DNA, 13 bp, Artificial Sequence
  synthetic sequence
gggtggtgtgtga

SEQ ID NO: 629 - DNA, 13 bp, Artificial Sequence
  synthetic sequence
atgcatcgtactc

SEQ ID NO: 630 - DNA, 13 bp, Artificial Sequence
  synthetic sequence
ccgaaaatgacac

SEQ ID NO: 631 - DNA, 13 bp, Artificial Sequence
  synthetic sequence
cttcacgtacggg

SEQ ID NO: 632 - DNA, 13 bp, Artificial Sequence
  synthetic sequence
tcagacagttgca

SEQ ID NO: 633 - DNA, 13 bp, Artificial Sequence
  synthetic sequence
gagtaatttgaga

SEQ ID NO: 634 - DNA, 13 bp, Artificial Sequence
  synthetic sequence
caacaggggatga

SEQ ID NO: 635 - DNA, 13 bp, Artificial Sequence
  synthetic sequence
gtggacgtggtct

SEQ ID NO: 636 - DNA, 13 bp, Artificial Sequence
  synthetic sequence
catttgtatggcc

SEQ ID NO: 637 - DNA, 13 bp, Artificial Sequence
  synthetic sequence
gctctgtcctttc

SEQ ID NO: 638 - DNA, 13 bp, Artificial Sequence
  synthetic sequence
aagcactcaacat

SEQ ID NO: 639 - DNA, 13 bp, Artificial Sequence
  synthetic sequence
ggcctctgtagta

SEQ ID NO: 640 - DNA, 13 bp, Artificial Sequence
  synthetic sequence
ttattgaagcatg

SEQ ID NO: 641 - DNA, 13 bp, Artificial Sequence
  synthetic sequence
gattttcagcgtt

SEQ ID NO: 642 - DNA, 13 bp, Artificial Sequence
  synthetic sequence
tgagaacagtacg

SEQ ID NO: 643 - DNA, 13 bp, Artificial Sequence
  synthetic sequence
gacaaccccatgt

SEQ ID NO: 644 - DNA, 13 bp, Artificial Sequence
  synthetic sequence
cataatgcacgga

SEQ ID NO: 645 - DNA, 13 bp, Artificial Sequence
  synthetic sequence
gtggttgtcagtc

SEQ ID NO: 646 - DNA, 13 bp, Artificial Sequence
  synthetic sequence
ttgttgaccaacc

SEQ ID NO: 647 - DNA, 13 bp, Artificial Sequence
  synthetic sequence
gcctgtatgacct

SEQ ID NO: 648 - DNA, 13 bp, Artificial Sequence
  synthetic sequence
ctttctctgatgc

SEQ ID NO: 649 - DNA, 13 bp, Artificial Sequence
  synthetic sequence
ctccgagcatctg

SEQ ID NO: 650 - DNA, 13 bp, Artificial Sequence
  synthetic sequence
atctttctgctgt

SEQ ID NO: 651 - DNA, 13 bp, Artificial Sequence
  synthetic sequence
aaccggcctcctg

SEQ ID NO: 652 - DNA, 13 bp, Artificial Sequence
  synthetic sequence
cgctctgtcgtct

SEQ ID NO: 653 - DNA, 13 bp, Artificial Sequence
  synthetic sequence
accctgctcgggt

SEQ ID NO: 654 - DNA, 13 bp, Artificial Sequence
  synthetic sequence
cttcacttgctcc

SEQ ID NO: 655 - DNA, 13 bp, Artificial Sequence
  synthetic sequence
tcagtgctgcaac

SEQ ID NO: 656 - DNA, 13 bp, Artificial Sequence
  synthetic sequence
tcgctgtctgtca

SEQ ID NO: 657 - DNA, 13 bp, Artificial Sequence
  synthetic sequence
cagtagcatgatg

SEQ ID NO: 658 - DNA, 13 bp, Artificial Sequence
  synthetic sequence
taccttaccttca

SEQ ID NO: 659 - DNA, 13 bp, Artificial Sequence
  synthetic sequence
gactcctgggaag

SEQ ID NO: 660 - DNA, 13 bp, Artificial Sequence
  synthetic sequence
tgcctgattgatt

SEQ ID NO: 661 - DNA, 13 bp, Artificial Sequence
  synthetic sequence
cgaaggtggccat

SEQ ID NO: 662 - DNA, 13 bp, Artificial Sequence
  synthetic sequence
cccggtccccttc

SEQ ID NO: 663 - DNA, 13 bp, Artificial Sequence
  synthetic sequence
ttagagagcagat

SEQ ID NO: 664 - DNA, 13 bp, Artificial Sequence
  synthetic sequence
acaccagaaggga

SEQ ID NO: 665 - DNA, 13 bp, Artificial Sequence
  synthetic sequence
aaccaagatgaac

SEQ ID NO: 666 - DNA, 13 bp, Artificial Sequence
  synthetic sequence
aaaccaacattgg

SEQ ID NO: 667 - DNA, 13 bp, Artificial Sequence
  synthetic sequence
ggacaaaagaagg

SEQ ID NO: 668 - DNA, 13 bp, Artificial Sequence
  synthetic sequence
gatgaggaaagag

SEQ ID NO: 669 - DNA, 13 bp, Artificial Sequence
  synthetic sequence
aacccatggatgg

SEQ ID NO: 670 - DNA, 13 bp, Artificial Sequence
  synthetic sequence
gaacacacaggaa

SEQ ID NO: 671 - DNA, 13 bp, Artificial Sequence
  synthetic sequence
ggtttgtggagag

SEQ ID NO: 672 - DNA, 13 bp, Artificial Sequence
  synthetic sequence
tggctagatgggg

SEQ ID NO: 673 - DNA, 13 bp, Artificial Sequence
  synthetic sequence
gacagccattgca

SEQ ID NO: 674 - DNA, 13 bp, Artificial Sequence
  synthetic sequence
ggaccatgaaaat

SEQ ID NO: 675 - DNA, 13 bp, Artificial Sequence
  synthetic sequence
cccaagacaacca

SEQ ID NO: 676 - DNA, 13 bp, Artificial Sequence
  synthetic sequence
aacatgtgcaccc

SEQ ID NO: 677 - DNA, 13 bp, Artificial Sequence
  synthetic sequence
caatgaaagaaaa

SEQ ID NO: 678 - DNA, 13 bp, Artificial Sequence
  synthetic sequence
gaagaggtgatga

SEQ ID NO: 679 - DNA, 13 bp, Artificial Sequence
  synthetic sequence
taccagagattga

SEQ ID NO: 680 - DNA, 13 bp, Artificial Sequence
  synthetic sequence
agagaggagttca

SEQ ID NO: 681 - DNA, 13 bp, Artificial Sequence
  synthetic sequence
tgaacattgtgga

SEQ ID NO: 682 - DNA, 13 bp, Artificial Sequence
  synthetic sequence
atagaaagtgaaa

SEQ ID NO: 683 - DNA, 13 bp, Artificial Sequence
  synthetic sequence
aaggcatgggagg

SEQ ID NO: 684 - DNA, 13 bp, Artificial Sequence
  synthetic sequence
gtggtgataggtt

SEQ ID NO: 685 - DNA, 13 bp, Artificial Sequence
  synthetic sequence
gatcagcctcatc

SEQ ID NO: 686 - DNA, 13 bp, Artificial Sequence
  synthetic sequence
gtgatattggtga

SEQ ID NO: 687 - DNA, 13 bp, Artificial Sequence
  synthetic sequence
cagtcaacattga

SEQ ID NO: 688 - DNA, 13 bp, Artificial Sequence
  synthetic sequence
tagcaggagcagg

SEQ ID NO: 689 - DNA, 13 bp, Artificial Sequence
  synthetic sequence
aagaagtgcaggt

SEQ ID NO: 690 - DNA, 13 bp, Artificial Sequence
  synthetic sequence
cagacaccataga

SEQ ID NO: 691 - DNA, 13 bp, Artificial Sequence
  synthetic sequence
tatgggacacacc

SEQ ID NO: 692 - DNA, 13 bp, Artificial Sequence
  synthetic sequence
gaagctcagccga

SEQ ID NO: 693 - DNA, 13 bp, Artificial Sequence
  synthetic sequence
cttggtttcatga

SEQ ID NO: 694 - DNA, 13 bp, Artificial Sequence
  synthetic sequence
aaacaacatggct

SEQ ID NO: 695 - DNA, 13 bp, Artificial Sequence
  synthetic sequence
gtggagacttggg

SEQ ID NO: 696 - DNA, 13 bp, Artificial Sequence
  synthetic sequence
aagtgtgtgacaa

SEQ ID NO: 697 - DNA, 13 bp, Artificial Sequence
  synthetic sequence
gctaaaatcatag

SEQ ID NO: 698 - DNA, 13 bp, Artificial Sequence
  synthetic sequence
attgttgcaatag

SEQ ID NO: 699 - DNA, 13 bp, Artificial Sequence
  synthetic sequence
caacagcagggat

SEQ ID NO: 700 - DNA, 13 bp, Artificial Sequence
  synthetic sequence
tggacaaaggaag

SEQ ID NO: 701 - DNA, 13 bp, Artificial Sequence
  synthetic sequence
gaacagggtgtgg

SEQ ID NO: 702 - DNA, 13 bp, Artificial Sequence
  synthetic sequence
cgaaaggctgaaa

SEQ ID NO: 703 - DNA, 13 bp, Artificial Sequence
  synthetic sequence
tagaagcagaacc

SEQ ID NO: 704 - DNA, 13 bp, Artificial Sequence
  synthetic sequence
tggcatctgtgga

SEQ ID NO: 705 - DNA, 13 bp, Artificial Sequence
  synthetic sequence
ggatcagcatcat

SEQ ID NO: 706 - DNA, 13 bp, Artificial Sequence
  synthetic sequence
agggttatagacc

SEQ ID NO: 707 - DNA, 13 bp, Artificial Sequence
  synthetic sequence
attgtgtcagcag

SEQ ID NO: 708 - DNA, 13 bp, Artificial Sequence
  synthetic sequence
gtgacatagggga

SEQ ID NO: 709 - DNA, 13 bp, Artificial Sequence
  synthetic sequence
tagtgtcatcagt

SEQ ID NO: 710 - DNA, 13 bp, Artificial Sequence
  synthetic sequence
cagagaattgaaa

SEQ ID NO: 711 - DNA, 13 bp, Artificial Sequence
  synthetic sequence
aaggaatcattcc

SEQ ID NO: 712 - DNA, 13 bp, Artificial Sequence
  synthetic sequence
acacatggaagat

SEQ ID NO: 713 - DNA, 13 bp, Artificial Sequence
  synthetic sequence
cggattggatacc

SEQ ID NO: 714 - DNA, 13 bp, Artificial Sequence
  synthetic sequence
ccagaatcccctt

SEQ ID NO: 715 - DNA, 13 bp, Artificial Sequence
  synthetic sequence
gacccaagacggt

SEQ ID NO: 716 - DNA, 13 bp, Artificial Sequence
  synthetic sequence
ggaaatagaggac

SEQ ID NO: 717 - DNA, 13 bp, Artificial Sequence
  synthetic sequence
taccaaaacaagg

SEQ ID NO: 718 - DNA, 13 bp, Artificial Sequence
  synthetic sequence
tgagaatggacaa

SEQ ID NO: 719 - DNA, 13 bp, Artificial Sequence
  synthetic sequence
catgcaaaaagaa

SEQ ID NO: 720 - DNA, 13 bp, Artificial Sequence
  synthetic sequence
ccagagaagaatt

SEQ ID NO: 721 - DNA, 13 bp, Artificial Sequence
  synthetic sequence
ggaacgaaacatg

SEQ ID NO: 722 - DNA, 13 bp, Artificial Sequence
  synthetic sequence
tggactatgaaaa

SEQ ID NO: 723 - DNA, 13 bp, Artificial Sequence
  synthetic sequence
tgactctaaaagg

SEQ ID NO: 724 - DNA, 13 bp, Artificial Sequence
  synthetic sequence
agtgaactgccgg

SEQ ID NO: 725 - DNA, 13 bp, Artificial Sequence
  synthetic sequence
agtttgaagccct

SEQ ID NO: 726 - DNA, 13 bp, Artificial Sequence
  synthetic sequence
tggacttgggaga

SEQ ID NO: 727 - DNA, 13 bp, Artificial Sequence
  synthetic sequence
ggaataacagtga

SEQ ID NO: 728 - DNA, 13 bp, Artificial Sequence
  synthetic sequence
cttggctggtgca

SEQ ID NO: 729 - DNA, 13 bp, Artificial Sequence
  synthetic sequence
atgtgtcatgcca

SEQ ID NO: 730 - DNA, 13 bp, Artificial Sequence
  synthetic sequence
ggagtattgtggg

SEQ ID NO: 731 - DNA, 13 bp, Artificial Sequence
  synthetic sequence
gcattgaagacaa

SEQ ID NO: 732 - DNA, 13 bp, Artificial Sequence
  synthetic sequence
ggacttctctttt

SEQ ID NO: 733 - DNA, 13 bp, Artificial Sequence
  synthetic sequence
ttggaactggaga

SEQ ID NO: 734 - DNA, 13 bp, Artificial Sequence
  synthetic sequence
gccctactggcta

SEQ ID NO: 735 - DNA, 13 bp, Artificial Sequence
  synthetic sequence
cagctatagccaa

SEQ ID NO: 736 - DNA, 13 bp, Artificial Sequence
  synthetic sequence
aaaatgctctcca

SEQ ID NO: 737 - DNA, 13 bp, Artificial Sequence
  synthetic sequence
caagagtggggcg

SEQ ID NO: 738 - DNA, 13 bp, Artificial Sequence
  synthetic sequence
gaaggagcttgga

SEQ ID NO: 739 - DNA, 13 bp, Artificial Sequence
  synthetic sequence
caagatgaagaaa

SEQ ID NO: 740 - DNA, 13 bp, Artificial Sequence
  synthetic sequence
gaacctccttttg

SEQ ID NO: 741 - DNA, 13 bp, Artificial Sequence
  synthetic sequence
gtgacattggaga

SEQ ID NO: 742 - DNA, 13 bp, Artificial Sequence
  synthetic sequence
atgataaatggag

SEQ ID NO: 743 - DNA, 13 bp, Artificial Sequence
  synthetic sequence
atagagggaaaag

SEQ ID NO: 744 - DNA, 13 bp, Artificial Sequence
  synthetic sequence
ccaagaagatgtc

SEQ ID NO: 745 - DNA, 13 bp, Artificial Sequence
  synthetic sequence
caatagacctaga

SEQ ID NO: 746 - DNA, 13 bp, Artificial Sequence
  synthetic sequence
acaatggaaacac

SEQ ID NO: 747 - DNA, 13 bp, Artificial Sequence
  synthetic sequence
tagtgacagctga

SEQ ID NO: 748 - DNA, 13 bp, Artificial Sequence
  synthetic sequence
caagggaagagtt

SEQ ID NO: 749 - DNA, 13 bp, Artificial Sequence
  synthetic sequence
aaggagtggagag

SEQ ID NO: 750 - DNA, 13 bp, Artificial Sequence
  synthetic sequence
gggacaagaggcc

SEQ ID NO: 751 - DNA, 13 bp, Artificial Sequence
  synthetic sequence
aaaagaatggaag

SEQ ID NO: 752 - DNA, 13 bp, Artificial Sequence
  synthetic sequence
caggagctgggct

SEQ ID NO: 753 - DNA, 13 bp, Artificial Sequence
  synthetic sequence
taccaaaacaaag

SEQ ID NO: 754 - DNA, 13 bp, Artificial Sequence
  synthetic sequence
atgaggaaaacag

SEQ ID NO: 755 - DNA, 13 bp, Artificial Sequence
  synthetic sequence
gaactcaagggga

SEQ ID NO: 756 - DNA, 13 bp, Artificial Sequence
  synthetic sequence
tgctactgaacag

SEQ ID NO: 757 - DNA, 13 bp, Artificial Sequence
  synthetic sequence
ggagccaggtacc

SEQ ID NO: 758 - DNA, 13 bp, Artificial Sequence
  synthetic sequence
tggatggtacata

SEQ ID NO: 759 - DNA, 13 bp, Artificial Sequence
  synthetic sequence
aggtgcaggttat

SEQ ID NO: 760 - DNA, 13 bp, Artificial Sequence
  synthetic sequence
atgagatccagat

SEQ ID NO: 761 - DNA, 13 bp, Artificial Sequence
  synthetic sequence
atggcaacaacgt

SEQ ID NO: 762 - DNA, 13 bp, Artificial Sequence
  synthetic sequence
cgtcagcagacct

SEQ ID NO: 763 - DNA, 13 bp, Artificial Sequence
  synthetic sequence
accatggctaaga

SEQ ID NO: 764 - DNA, 13 bp, Artificial Sequence
  synthetic sequence
aaaattggaatag

SEQ ID NO: 765 - DNA, 13 bp, Artificial Sequence
  synthetic sequence
ggaattgatgatg

SEQ ID NO: 766 - DNA, 13 bp, Artificial Sequence
  synthetic sequence
ggcgttctatggg

SEQ ID NO: 767 - DNA, 13 bp, Artificial Sequence
  synthetic sequence
acatgtgtaccct

SEQ ID NO: 768 - DNA, 13 bp, Artificial Sequence
  synthetic sequence
tccctaacagcca

SEQ ID NO: 769 - DNA, 13 bp, Artificial Sequence
  synthetic sequence
aagcttgcttaac

SEQ ID NO: 770 - DNA, 13 bp, Artificial Sequence
  synthetic sequence
aatgcagaaccag

SEQ ID NO: 771 - DNA, 13 bp, Artificial Sequence
  synthetic sequence
ccaacagcaggaa

SEQ ID NO: 772 - DNA, 13 bp, Artificial Sequence
  synthetic sequence
gggtaatagaccc

SEQ ID NO: 773 - DNA, 13 bp, Artificial Sequence
  synthetic sequence
agactaaaaatgg

SEQ ID NO: 774 - DNA, 13 bp, Artificial Sequence
  synthetic sequence
tgaacatgacatc

SEQ ID NO: 775 - DNA, 13 bp, Artificial Sequence
  synthetic sequence
atgtgtcacgcca

SEQ ID NO: 776 - DNA, 13 bp, Artificial Sequence
  synthetic sequence
aagaaagagaaat

SEQ ID NO: 777 - DNA, 13 bp, Artificial Sequence
  synthetic sequence
ggttcgtcgagag

SEQ ID NO: 778 - DNA, 13 bp, Artificial Sequence
  synthetic sequence
tggcatccgtgga

SEQ ID NO: 779 - DNA, 13 bp, Artificial Sequence
  synthetic sequence
tatcaaaacaagg

SEQ ID NO: 780 - DNA, 13 bp, Artificial Sequence
  synthetic sequence
tggttcgtggaga

SEQ ID NO: 781 - DNA, 13 bp, Artificial Sequence
  synthetic sequence
atttccctgacag

SEQ ID NO: 782 - DNA, 13 bp, Artificial Sequence
  synthetic sequence
aaaccaaccttgg

SEQ ID NO: 783 - DNA, 13 bp, Artificial Sequence
  synthetic sequence
tatcaaaacaaag

SEQ ID NO: 784 - DNA, 13 bp, Artificial Sequence
  synthetic sequence
atggcgtcgaaag

SEQ ID NO: 785 - DNA, 13 bp, Artificial Sequence
  synthetic sequence
tcctttcccaaag

SEQ ID NO: 786 - DNA, 13 bp, Artificial Sequence
  synthetic sequence
tcatagccatcct

SEQ ID NO: 787 - DNA, 13 bp, Artificial Sequence
  synthetic sequence
tgacgacgatggc

SEQ ID NO: 788 - DNA, 13 bp, Artificial Sequence
  synthetic sequence
ttgcaatagattt

SEQ ID NO: 789 - DNA, 13 bp, Artificial Sequence
  synthetic sequence
aatttgaagccct

SEQ ID NO: 790 - DNA, 13 bp, Artificial Sequence
  synthetic sequence
accaggcagtggt

SEQ ID NO: 791 - DNA, 13 bp, Artificial Sequence
  synthetic sequence
tgcactctcattg

SEQ ID NO: 792 - DNA, 13 bp, Artificial Sequence
  synthetic sequence
aacgcagaaccag

SEQ ID NO: 793 - DNA, 13 bp, Artificial Sequence
  synthetic sequence
gacatctcaagtg

SEQ ID NO: 794 - DNA, 13 bp, Artificial Sequence
  synthetic sequence
tggaacagagtgt

SEQ ID NO: 795 - DNA, 13 bp, Artificial Sequence
  synthetic sequence
tcataggagcaga

SEQ ID NO: 796 - DNA, 13 bp, Artificial Sequence
  synthetic sequence
acaatccagagat

SEQ ID NO: 797 - DNA, 13 bp, Artificial Sequence
  synthetic sequence
acgtcccttcacc

SEQ ID NO: 798 - DNA, 13 bp, Artificial Sequence
  synthetic sequence
ggagctacttggc

SEQ ID NO: 799 - DNA, 13 bp, Artificial Sequence
  synthetic sequence
gttatcaagaatg

SEQ ID NO: 800 - DNA, 13 bp, Artificial Sequence
  synthetic sequence
gttccatgtagaa

SEQ ID NO: 801 - DNA, 13 bp, Artificial Sequence
  synthetic sequence
acgtgtgctaagt

SEQ ID NO: 802 - DNA, 13 bp, Artificial Sequence
  synthetic sequence
ccatggtgaacgg

SEQ ID NO: 803 - DNA, 13 bp, Artificial Sequence
  synthetic sequence
accaagccacagt

SEQ ID NO: 804 - DNA, 13 bp, Artificial Sequence
  synthetic sequence
tgaacaggttcac

SEQ ID NO: 805 - DNA, 13 bp, Artificial Sequence
  synthetic sequence
gaaaggtcatgga

SEQ ID NO: 806 - DNA, 13 bp, Artificial Sequence
  synthetic sequence
gagagctcaaaaa

SEQ ID NO: 807 - DNA, 13 bp, Artificial Sequence
  synthetic sequence
tggccatgacaac

SEQ ID NO: 808 - DNA, 13 bp, Artificial Sequence
  synthetic sequence
tggactagagagg

SEQ ID NO: 809 - DNA, 13 bp, Artificial Sequence
  synthetic sequence
tagaaccaatatc

SEQ ID NO: 810 - DNA, 13 bp, Artificial Sequence
  synthetic sequence
gaaataacagcac

SEQ ID NO: 811 - DNA, 13 bp, Artificial Sequence
  synthetic sequence
atagaggaaggaa

SEQ ID NO: 812 - DNA, 13 bp, Artificial Sequence
  synthetic sequence
tgacatgtgcgaa

SEQ ID NO: 813 - DNA, 13 bp, Artificial Sequence
  synthetic sequence
ggagagtgataga

SEQ ID NO: 814 - DNA, 13 bp, Artificial Sequence
  synthetic sequence
attatcccagccc

SEQ ID NO: 815 - DNA, 13 bp, Artificial Sequence
  synthetic sequence
gagaaatggctga

SEQ ID NO: 816 - DNA, 13 bp, Artificial Sequence
  synthetic sequence
ctcataaagaatg

SEQ ID NO: 817 - DNA, 13 bp, Artificial Sequence
  synthetic sequence
tgtcactagagaa

SEQ ID NO: 818 - DNA, 13 bp, Artificial Sequence
  synthetic sequence
acaagacaatcaa

SEQ ID NO: 819 - DNA, 13 bp, Artificial Sequence
  synthetic sequence
agccagattatga

SEQ ID NO: 820 - DNA, 13 bp, Artificial Sequence
  synthetic sequence
aagggatcattcc

SEQ ID NO: 821 - DNA, 13 bp, Artificial Sequence
  synthetic sequence
ctcatagccatgg

SEQ ID NO: 822 - DNA, 13 bp, Artificial Sequence
  synthetic sequence
ccatctttgagga

SEQ ID NO: 823 - DNA, 13 bp, Artificial Sequence
  synthetic sequence
tggcttccggtgc

SEQ ID NO: 824 - DNA, 13 bp, Artificial Sequence
  synthetic sequence
tcatgcttgtagc

SEQ ID NO: 825 - DNA, 13 bp, Artificial Sequence
  synthetic sequence
gggacaaagaaga

SEQ ID NO: 826 - DNA, 13 bp, Artificial Sequence
  synthetic sequence
tggaagaatgctt

SEQ ID NO: 827 - DNA, 13 bp, Artificial Sequence
  synthetic sequence
ccagagtccccag

SEQ ID NO: 828 - DNA, 13 bp, Artificial Sequence
  synthetic sequence
gagtctcatggat

SEQ ID NO: 829 - DNA, 13 bp, Artificial Sequence
  synthetic sequence
ccagagacacaga

SEQ ID NO: 830 - DNA, 13 bp, Artificial Sequence
  synthetic sequence
caaaagggaaagt

SEQ ID NO: 831 - DNA, 13 bp, Artificial Sequence
  synthetic sequence
gaattagaacccc

SEQ ID NO: 832 - DNA, 13 bp, Artificial Sequence
  synthetic sequence
aaagcaaaaatct

SEQ ID NO: 833 - DNA, 13 bp, Artificial Sequence
  synthetic sequence
ggcaaagcgaaaa

SEQ ID NO: 834 - DNA, 13 bp, Artificial Sequence
  synthetic sequence
gccctccagaagt

SEQ ID NO: 835 - DNA, 13 bp, Artificial Sequence
  synthetic sequence
tggcttggagcac

SEQ ID NO: 836 - DNA, 13 bp, Artificial Sequence
  synthetic sequence
tacaaagagtgga

SEQ ID NO: 837 - DNA, 13 bp, Artificial Sequence
  synthetic sequence
gtgattgacctag

SEQ ID NO: 838 - DNA, 13 bp, Artificial Sequence
  synthetic sequence
tgctgcagatgga

SEQ ID NO: 839 - DNA, 13 bp, Artificial Sequence
  synthetic sequence
ccaaccaggcagc

SEQ ID NO: 840 - DNA, 13 bp, Artificial Sequence
  synthetic sequence
gaaggggcttgga

SEQ ID NO: 841 - DNA, 13 bp, Artificial Sequence
  synthetic sequence
caaagatcaggag

SEQ ID NO: 842 - DNA, 13 bp, Artificial Sequence
  synthetic sequence
tggaacacgggag

SEQ ID NO: 843 - DNA, 13 bp, Artificial Sequence
  synthetic sequence
cgttgatgctcct

SEQ ID NO: 844 - DNA, 13 bp, Artificial Sequence
  synthetic sequence
gacgtaagatggg

SEQ ID NO: 845 - DNA, 13 bp, Artificial Sequence
  synthetic sequence
agctgacctatca

SEQ ID NO: 846 - DNA, 13 bp, Artificial Sequence
  synthetic sequence
ggagtctcttggg

SEQ ID NO: 847 - DNA, 13 bp, Artificial Sequence
  synthetic sequence
gtctggaataggg

SEQ ID NO: 848 - DNA, 13 bp, Artificial Sequence
  synthetic sequence
ggaattaatgatg

SEQ ID NO: 849 - DNA, 13 bp, Artificial Sequence
  synthetic sequence
gaaaggcgaaaat

SEQ ID NO: 850 - DNA, 13 bp, Artificial Sequence
  synthetic sequence
tcaagccatcagg

SEQ ID NO: 851 - DNA, 13 bp, Artificial Sequence
  synthetic sequence
cacaagggaagaa

SEQ ID NO: 852 - DNA, 13 bp, Artificial Sequence
  synthetic sequence
ggacaaaagaggg

SEQ ID NO: 853 - DNA, 13 bp, Artificial Sequence
  synthetic sequence
caatcatggatga

SEQ ID NO: 854 - DNA, 13 bp, Artificial Sequence
  synthetic sequence
tagaagaaggaag

SEQ ID NO: 855 - DNA, 13 bp, Artificial Sequence
  synthetic sequence
aggtctcctggga

SEQ ID NO: 856 - DNA, 13 bp, Artificial Sequence
  synthetic sequence
tggacattgaact

SEQ ID NO: 857 - DNA, 13 bp, Artificial Sequence
  synthetic sequence
tggaaaaacatgg

SEQ ID NO: 858 - DNA, 13 bp, Artificial Sequence
  synthetic sequence
gtgataggcatac

SEQ ID NO: 859 - DNA, 13 bp, Artificial Sequence
  synthetic sequence
atgtgccatgcca

SEQ ID NO: 860 - DNA, 13 bp, Artificial Sequence
  synthetic sequence
gaagaaatgctca

SEQ ID NO: 861 - DNA, 13 bp, Artificial Sequence
  synthetic sequence
gttccatgcagaa

SEQ ID NO: 862 - DNA, 13 bp, Artificial Sequence
  synthetic sequence
gagaccctggaga

SEQ ID NO: 863 - DNA, 13 bp, Artificial Sequence
  synthetic sequence
agattgttgatct

SEQ ID NO: 864 - DNA, 13 bp, Artificial Sequence
  synthetic sequence
agaagttcttctt

SEQ ID NO: 865 - DNA, 13 bp, Artificial Sequence
  synthetic sequence
gagaagcaatgca

SEQ ID NO: 866 - DNA, 13 bp, Artificial Sequence
  synthetic sequence
aaaaagcagcaga

SEQ ID NO: 867 - DNA, 13 bp, Artificial Sequence
  synthetic sequence
ttgaggcagaacc

SEQ ID NO: 868 - DNA, 13 bp, Artificial Sequence
  synthetic sequence
cctgtgctatgtt

SEQ ID NO: 869 - DNA, 13 bp, Artificial Sequence
  synthetic sequence
aggtcaaacgcag

SEQ ID NO: 870 - DNA, 13 bp, Artificial Sequence
  synthetic sequence
atagagcttcaga

SEQ ID NO: 871 - DNA, 13 bp, Artificial Sequence
  synthetic sequence
taccaaaataagg

SEQ ID NO: 872 - DNA, 13 bp, Artificial Sequence
  synthetic sequence
ctgactccccaaa

SEQ ID NO: 873 - DNA, 13 bp, Artificial Sequence
  synthetic sequence
ggggtctcatgga

SEQ ID NO: 874 - DNA, 13 bp, Artificial Sequence
  synthetic sequence
tggtttgtggaaa

SEQ ID NO: 875 - DNA, 13 bp, Artificial Sequence
  synthetic sequence
agttctaacagtt

SEQ ID NO: 876 - DNA, 13 bp, Artificial Sequence
  synthetic sequence
cagctctctttga

SEQ ID NO: 877 - DNA, 13 bp, Artificial Sequence
  synthetic sequence
ggacacttgaaat

SEQ ID NO: 878 - DNA, 13 bp, Artificial Sequence
  synthetic sequence
gttgtcaagaatg

SEQ ID NO: 879 - DNA, 13 bp, Artificial Sequence
  synthetic sequence
cacaatggcaaaa

SEQ ID NO: 880 - DNA, 13 bp, Artificial Sequence
  synthetic sequence
gcttcagctatcc

SEQ ID NO: 881 - DNA, 13 bp, Artificial Sequence
  synthetic sequence
tctttaagaacaa

SEQ ID NO: 882 - DNA, 13 bp, Artificial Sequence
  synthetic sequence
aaagcatggatgg

SEQ ID NO: 883 - DNA, 13 bp, Artificial Sequence
  synthetic sequence
gaactagagagag

SEQ ID NO: 884 - DNA, 13 bp, Artificial Sequence
  synthetic sequence
gaagaagtgatga

SEQ ID NO: 885 - DNA, 13 bp, Artificial Sequence
  synthetic sequence
tgtgtactctcat

SEQ ID NO: 886 - DNA, 13 bp, Artificial Sequence
  synthetic sequence
gaaccagagcgtg

SEQ ID NO: 887 - DNA, 13 bp, Artificial Sequence
  synthetic sequence
tagagttcgaagc

SEQ ID NO: 888 - DNA, 13 bp, Artificial Sequence
  synthetic sequence
ttgttattcatga

SEQ ID NO: 889 - DNA, 13 bp, Artificial Sequence
  synthetic sequence
tggtgagagctac

SEQ ID NO: 890 - DNA, 13 bp, Artificial Sequence
  synthetic sequence
tggataccattag

SEQ ID NO: 891 - DNA, 13 bp, Artificial Sequence
  synthetic sequence
aatgatacatgga

SEQ ID NO: 892 - DNA, 13 bp, Artificial Sequence
  synthetic sequence
tgaaggcgcttgg

SEQ ID NO: 893 - DNA, 13 bp, Artificial Sequence
  synthetic sequence
ttggatcctgtgg

SEQ ID NO: 894 - DNA, 13 bp, Artificial Sequence
  synthetic sequence
cctggaagctggc

SEQ ID NO: 895 - DNA, 13 bp, Artificial Sequence
  synthetic sequence
atccatggatgga

SEQ ID NO: 896 - DNA, 13 bp, Artificial Sequence
  synthetic sequence
gatttatcattgg

SEQ ID NO: 897 - DNA, 13 bp, Artificial Sequence
  synthetic sequence
gcagacctcagga

SEQ ID NO: 898 - DNA, 13 bp, Artificial Sequence
  synthetic sequence
caacgggctggag

SEQ ID NO: 899 - DNA, 13 bp, Artificial Sequence
  synthetic sequence
gtggtgataggtc

SEQ ID NO: 900 - DNA, 13 bp, Artificial Sequence
  synthetic sequence
acagtgctaatgg

SEQ ID NO: 901 - DNA, 13 bp, Artificial Sequence
  synthetic sequence
agatggacaaatt

SEQ ID NO: 902 - DNA, 13 bp, Artificial Sequence
  synthetic sequence
tggattttgaact

SEQ ID NO: 903 - DNA, 13 bp, Artificial Sequence
  synthetic sequence
agcacacaggaag

SEQ ID NO: 904 - DNA, 13 bp, Artificial Sequence
  synthetic sequence
tggatttgggaga

SEQ ID NO: 905 - DNA, 13 bp, Artificial Sequence
  synthetic sequence
tcttcgagcatga

SEQ ID NO: 906 - DNA, 13 bp, Artificial Sequence
  synthetic sequence
gctatattgatgg

SEQ ID NO: 907 - DNA, 13 bp, Artificial Sequence
  synthetic sequence
gccattgccaacc

SEQ ID NO: 908 - DNA, 13 bp, Artificial Sequence
  synthetic sequence
gaaggggcctgga

SEQ ID NO: 909 - DNA, 13 bp, Artificial Sequence
  synthetic sequence
ttccgggccgaca

SEQ ID NO: 910 - DNA, 13 bp, Artificial Sequence
  synthetic sequence
atgtcaaatggga

SEQ ID NO: 911 - DNA, 13 bp, Artificial Sequence
  synthetic sequence
gaaagccaaaaga

SEQ ID NO: 912 - DNA, 13 bp, Artificial Sequence
  synthetic sequence
atggcaacaacgc

SEQ ID NO: 913 - DNA, 13 bp, Artificial Sequence
  synthetic sequence
ccaccttcatcat

SEQ ID NO: 914 - DNA, 13 bp, Artificial Sequence
  synthetic sequence
atctggacgaaag

SEQ ID NO: 915 - DNA, 13 bp, Artificial Sequence
  synthetic sequence
ttgtgaaaccaga

SEQ ID NO: 916 - DNA, 13 bp, Artificial Sequence
  synthetic sequence
gtgccatgccgca

SEQ ID NO: 917 - DNA, 13 bp, Artificial Sequence
  synthetic sequence
tgagaggaaaatt

SEQ ID NO: 918 - DNA, 13 bp, Artificial Sequence
  synthetic sequence
ttttctatcatga

SEQ ID NO: 919 - DNA, 13 bp, Artificial Sequence
  synthetic sequence
tagagacactgct

SEQ ID NO: 920 - DNA, 13 bp, Artificial Sequence
  synthetic sequence
acaagagaagagt

SEQ ID NO: 921 - DNA, 13 bp, Artificial Sequence
  synthetic sequence
gtcccatgcagaa

SEQ ID NO: 922 - DNA, 13 bp, Artificial Sequence
  synthetic sequence
catggaactcagg

SEQ ID NO: 923 - DNA, 13 bp, Artificial Sequence
  synthetic sequence
caccaaatcccac

SEQ ID NO: 924 - DNA, 13 bp, Artificial Sequence
  synthetic sequence
cttgagttcgaag

SEQ ID NO: 925 - DNA, 13 bp, Artificial Sequence
  synthetic sequence
attgccatggacc

SEQ ID NO: 926 - DNA, 13 bp, Artificial Sequence
  synthetic sequence
gtggaaatcgagg

SEQ ID NO: 927 - DNA, 13 bp, Artificial Sequence
  synthetic sequence
tgtacagaactgg

SEQ ID NO: 928 - DNA, 13 bp, Artificial Sequence
  synthetic sequence
taccaaaataaag

SEQ ID NO: 929 - DNA, 13 bp, Artificial Sequence
  synthetic sequence
acaaacaatggtt

SEQ ID NO: 930 - DNA, 13 bp, Artificial Sequence
  synthetic sequence
caacagcaggagt

SEQ ID NO: 931 - DNA, 13 bp, Artificial Sequence
  synthetic sequence
cacctgaaatgca

SEQ ID NO: 932 - DNA, 13 bp, Artificial Sequence
  synthetic sequence
acatgatttcaag

SEQ ID NO: 933 - DNA, 13 bp, Artificial Sequence
  synthetic sequence
ttcagcggtgttt

SEQ ID NO: 934 - DNA, 13 bp, Artificial Sequence
  synthetic sequence
tgacctacgttgt

SEQ ID NO: 935 - DNA, 13 bp, Artificial Sequence
  synthetic sequence
aaggagaatggaa

SEQ ID NO: 936 - DNA, 13 bp, Artificial Sequence
  synthetic sequence
ctaaagcatcaca

SEQ ID NO: 937 - DNA, 13 bp, Artificial Sequence
  synthetic sequence
tcatggaattcag

SEQ ID NO: 938 - DNA, 13 bp, Artificial Sequence
  synthetic sequence
acacaacatcaaa

SEQ ID NO: 939 - DNA, 13 bp, Artificial Sequence
  synthetic sequence
atggagaaattga

SEQ ID NO: 940 - DNA, 13 bp, Artificial Sequence
  synthetic sequence
taaacatgacatc

SEQ ID NO: 941 - DNA, 13 bp, Artificial Sequence
  synthetic sequence
aatggttggaaac

SEQ ID NO: 942 - DNA, 13 bp, Artificial Sequence
  synthetic sequence
aaaagatggggaa

SEQ ID NO: 943 - DNA, 13 bp, Artificial Sequence
  synthetic sequence
ggctgaaaagaat

SEQ ID NO: 944 - DNA, 13 bp, Artificial Sequence
  synthetic sequence
cagatggattgtt

SEQ ID NO: 945 - DNA, 13 bp, Artificial Sequence
  synthetic sequence
gatctctgatgaa

SEQ ID NO: 946 - DNA, 13 bp, Artificial Sequence
  synthetic sequence
gtcatcacagaaa

SEQ ID NO: 947 - DNA, 13 bp, Artificial Sequence
  synthetic sequence
atagaccccagac

SEQ ID NO: 948 - DNA, 13 bp, Artificial Sequence
  synthetic sequence
tggcgacagccat

SEQ ID NO: 949 - DNA, 13 bp, Artificial Sequence
  synthetic sequence
gaaaagccaaaat

SEQ ID NO: 950 - DNA, 13 bp, Artificial Sequence
  synthetic sequence
gagactctggaga

SEQ ID NO: 951 - DNA, 13 bp, Artificial Sequence
  synthetic sequence
tgactgaggactg

SEQ ID NO: 952 - DNA, 13 bp, Artificial Sequence
  synthetic sequence
ggaggaactacca

SEQ ID NO: 953 - DNA, 13 bp, Artificial Sequence
  synthetic sequence
gaaggagcctgga

SEQ ID NO: 954 - DNA, 13 bp, Artificial Sequence
  synthetic sequence
tgttaggagttgg

SEQ ID NO: 955 - DNA, 13 bp, Artificial Sequence
  synthetic sequence
tttggtccggaaa

SEQ ID NO: 956 - DNA, 13 bp, Artificial Sequence
  synthetic sequence
aatatgctgaaac

SEQ ID NO: 957 - DNA, 13 bp, Artificial Sequence
  synthetic sequence
atatttaagctca

SEQ ID NO: 958 - DNA, 13 bp, Artificial Sequence
  synthetic sequence
ggaaaggcaaaaa

SEQ ID NO: 959 - DNA, 13 bp, Artificial Sequence
  synthetic sequence
tggaccctgtggt

SEQ ID NO: 960 - DNA, 13 bp, Artificial Sequence
  synthetic sequence
aaagcaaagatct

SEQ ID NO: 961 - DNA, 13 bp, Artificial Sequence
  synthetic sequence
aatcttcaccaag

SEQ ID NO: 962 - DNA, 13 bp, Artificial Sequence
  synthetic sequence
gagctcgcttcct

SEQ ID NO: 963 - DNA, 13 bp, Artificial Sequence
  synthetic sequence
aatgcccacaaag

SEQ ID NO: 964 - DNA, 13 bp, Artificial Sequence
  synthetic sequence
atagagctccaga

SEQ ID NO: 965 - DNA, 13 bp, Artificial Sequence
  synthetic sequence
ggagacaaatggg

SEQ ID NO: 966 - DNA, 13 bp, Artificial Sequence
  synthetic sequence
ttcagtcaacatg

SEQ ID NO: 967 - DNA, 13 bp, Artificial Sequence
  synthetic sequence
ctatggcttaatc

SEQ ID NO: 968 - DNA, 13 bp, Artificial Sequence
  synthetic sequence
gtttctcctcttt

SEQ ID NO: 969 - DNA, 13 bp, Artificial Sequence
  synthetic sequence
agcatttttgctt

SEQ ID NO: 970 - DNA, 13 bp, Artificial Sequence
  synthetic sequence
ggagtggctgtca

SEQ ID NO: 971 - DNA, 13 bp, Artificial Sequence
  synthetic sequence
tgaatctcttcat

SEQ ID NO: 972 - DNA, 13 bp, Artificial Sequence
  synthetic sequence
tattgctctgtcc

SEQ ID NO: 973 - DNA, 13 bp, Artificial Sequence
  synthetic sequence
tccatgggttgtg

SEQ ID NO: 974 - DNA, 13 bp, Artificial Sequence
  synthetic sequence
ccccagcctctgt

SEQ ID NO: 975 - DNA, 13 bp, Artificial Sequence
  synthetic sequence
ccatgttctcctc

SEQ ID NO: 976 - DNA, 13 bp, Artificial Sequence
  synthetic sequence
tttctggttctgg

SEQ ID NO: 977 - DNA, 13 bp, Artificial Sequence
  synthetic sequence
ccatttctgaaat

SEQ ID NO: 978 - DNA, 13 bp, Artificial Sequence
  synthetic sequence
gttgtcatccatt

SEQ ID NO: 979 - DNA, 13 bp, Artificial Sequence
  synthetic sequence
tttggatttctgt

SEQ ID NO: 980 - DNA, 13 bp, Artificial Sequence
  synthetic sequence
tcgtggtgttcca

SEQ ID NO: 981 - DNA, 13 bp, Artificial Sequence
  synthetic sequence
cccacgttttgta

SEQ ID NO: 982 - DNA, 13 bp, Artificial Sequence
  synthetic sequence
cgtactgtggctt

SEQ ID NO: 983 - DNA, 13 bp, Artificial Sequence
  synthetic sequence
tggtaccttattg

SEQ ID NO: 984 - DNA, 13 bp, Artificial Sequence
  synthetic sequence
tcctagtgaaaag

SEQ ID NO: 985 - DNA, 13 bp, Artificial Sequence
  synthetic sequence
taggcccatgttt

SEQ ID NO: 986 - DNA, 13 bp, Artificial Sequence
  synthetic sequence
atgtaccatattg

SEQ ID NO: 987 - DNA, 13 bp, Artificial Sequence
  synthetic sequence
tctggctctggaa

SEQ ID NO: 988 - DNA, 13 bp, Artificial Sequence
  synthetic sequence
tggcactgacgta

SEQ ID NO: 989 - DNA, 13 bp, Artificial Sequence
  synthetic sequence
caacttccatgtt

SEQ ID NO: 990 - DNA, 13 bp, Artificial Sequence
  synthetic sequence
tctttttctgcca

SEQ ID NO: 991 - DNA, 13 bp, Artificial Sequence
  synthetic sequence
ttcctctttcctg

SEQ ID NO: 992 - DNA, 13 bp, Artificial Sequence
  synthetic sequence
tcattattccggc

SEQ ID NO: 993 - DNA, 13 bp, Artificial Sequence
  synthetic sequence
tcatcatgggagt

SEQ ID NO: 994 - DNA, 13 bp, Artificial Sequence
  synthetic sequence
cctgttccacatg

SEQ ID NO: 995 - DNA, 13 bp, Artificial Sequence
  synthetic sequence
actgccttgctgt

SEQ ID NO: 996 - DNA, 13 bp, Artificial Sequence
  synthetic sequence
ctccatatgagat

SEQ ID NO: 997 - DNA, 13 bp, Artificial Sequence
  synthetic sequence
catgcctccagct

SEQ ID NO: 998 - DNA, 13 bp, Artificial Sequence
  synthetic sequence
atgtctgttgtga

SEQ ID NO: 999 - DNA, 13 bp, Artificial Sequence
  synthetic sequence
ttcctccttgttc

SEQ ID NO: 1000 - DNA, 13 bp, Artificial Sequence
  synthetic sequence
ttttctttgtcag

SEQ ID NO: 1001 - DNA, 13 bp, Artificial Sequence
  synthetic sequence
gtggagtttcgtg

SEQ ID NO: 1002 - DNA, 13 bp, Artificial Sequence
  synthetic sequence
tggatgttagtct

SEQ ID NO: 1003 - DNA, 13 bp, Artificial Sequence
  synthetic sequence
gtgtcacatttct

SEQ ID NO: 1004 - DNA, 13 bp, Artificial Sequence
  synthetic sequence
tcagctggtggaa

SEQ ID NO: 1005 - DNA, 13 bp, Artificial Sequence
  synthetic sequence
agtcccacgtgtg

SEQ ID NO: 1006 - DNA, 13 bp, Artificial Sequence
  synthetic sequence
ccatctttcatga

SEQ ID NO: 1007 - DNA, 13 bp, Artificial Sequence
  synthetic sequence
ccatgatgtcagt

SEQ ID NO: 1008 - DNA, 13 bp, Artificial Sequence
  synthetic sequence
aaccccataacca

SEQ ID NO: 1009 - DNA, 13 bp, Artificial Sequence
  synthetic sequence
tgtcacacttttc

SEQ ID NO: 1010 - DNA, 13 bp, Artificial Sequence
  synthetic sequence
cctgttctaggtg

SEQ ID NO: 1011 - DNA, 13 bp, Artificial Sequence
  synthetic sequence
taccatatggctc

SEQ ID NO: 1012 - DNA, 13 bp, Artificial Sequence
  synthetic sequence
tccaacttgccta

SEQ ID NO: 1013 - DNA, 13 bp, Artificial Sequence
  synthetic sequence
atgacatccatgt

SEQ ID NO: 1014 - DNA, 13 bp, Artificial Sequence
  synthetic sequence
tattgttctgtcc

SEQ ID NO: 1015 - DNA, 13 bp, Artificial Sequence
  synthetic sequence
catctcattgaag

SEQ ID NO: 1016 - DNA, 13 bp, Artificial Sequence
  synthetic sequence
tggtatcttattg

SEQ ID NO: 1017 - DNA, 13 bp, Artificial Sequence
  synthetic sequence
cccatcctctgtc

SEQ ID NO: 1018 - DNA, 13 bp, Artificial Sequence
  synthetic sequence
cctccagccacta

SEQ ID NO: 1019 - DNA, 13 bp, Artificial Sequence
  synthetic sequence
tctggatttctgt

SEQ ID NO: 1020 - DNA, 13 bp, Artificial Sequence
  synthetic sequence
ccatgttttccat

SEQ ID NO: 1021 - DNA, 13 bp, Artificial Sequence
  synthetic sequence
atgcagttccaaa

SEQ ID NO: 1022 - DNA, 13 bp, Artificial Sequence
  synthetic sequence
agtcttcatcatt

SEQ ID NO: 1023 - DNA, 13 bp, Artificial Sequence
  synthetic sequence
agacttttccctt

SEQ ID NO: 1024 - DNA, 13 bp, Artificial Sequence
  synthetic sequence
ccatgtcggcatg

SEQ ID NO: 1025 - DNA, 13 bp, Artificial Sequence
  synthetic sequence
atttggttgttct

SEQ ID NO: 1026 - DNA, 13 bp, Artificial Sequence
  synthetic sequence
ctcaacattggtg

SEQ ID NO: 1027 - DNA, 13 bp, Artificial Sequence
  synthetic sequence
attgacagtacca

SEQ ID NO: 1028 - DNA, 13 bp, Artificial Sequence
  synthetic sequence
gagcatgattgta

SEQ ID NO: 1029 - DNA, 13 bp, Artificial Sequence
  synthetic sequence
gtgtctttttctt

SEQ ID NO: 1030 - DNA, 13 bp, Artificial Sequence
  synthetic sequence
aagtccatctcaa

SEQ ID NO: 1031 - DNA, 13 bp, Artificial Sequence
  synthetic sequence
ggctaaatttggg

SEQ ID NO: 1032 - DNA, 13 bp, Artificial Sequence
  synthetic sequence
ccatagattgctc

SEQ ID NO: 1033 - DNA, 13 bp, Artificial Sequence
  synthetic sequence
cccacaggtacca

SEQ ID NO: 1034 - DNA, 13 bp, Artificial Sequence
  synthetic sequence
ctccactccttgt

SEQ ID NO: 1035 - DNA, 13 bp, Artificial Sequence
  synthetic sequence
cctccatatgata

SEQ ID NO: 1036 - DNA, 13 bp, Artificial Sequence
  synthetic sequence
caaaagttggtct

SEQ ID NO: 1037 - DNA, 13 bp, Artificial Sequence
  synthetic sequence
tgttagccattga

SEQ ID NO: 1038 - DNA, 13 bp, Artificial Sequence
  synthetic sequence
ttcattattccag

SEQ ID NO: 1039 - DNA, 13 bp, Artificial Sequence
  synthetic sequence
gtcatccactgat

SEQ ID NO: 1040 - DNA, 13 bp, Artificial Sequence
  synthetic sequence
ttgtgcaactcac

SEQ ID NO: 1041 - DNA, 13 bp, Artificial Sequence
  synthetic sequence
acccacgtagctc

SEQ ID NO: 1042 - DNA, 13 bp, Artificial Sequence
  synthetic sequence
cctctttcattct

SEQ ID NO: 1043 - DNA, 13 bp, Artificial Sequence
  synthetic sequence
cccagtttggttc

SEQ ID NO: 1044 - DNA, 13 bp, Artificial Sequence
  synthetic sequence
ggtgcaccatttt

SEQ ID NO: 1045 - DNA, 13 bp, Artificial Sequence
  synthetic sequence
ttttcctcattgt

SEQ ID NO: 1046 - DNA, 13 bp, Artificial Sequence
  synthetic sequence
tagcacgctatca

SEQ ID NO: 1047 - DNA, 13 bp, Artificial Sequence
  synthetic sequence
cccattgtgaagt

SEQ ID NO: 1048 - DNA, 13 bp, Artificial Sequence
  synthetic sequence
gacatccaggttt

SEQ ID NO: 1049 - DNA, 13 bp, Artificial Sequence
  synthetic sequence
ctgtccgtggtga

SEQ ID NO: 1050 - DNA, 13 bp, Artificial Sequence
  synthetic sequence
ttttgttccttcc

SEQ ID NO: 1051 - DNA, 13 bp, Artificial Sequence
  synthetic sequence
ttgttccttcaca

SEQ ID NO: 1052 - DNA, 13 bp, Artificial Sequence
  synthetic sequence
gctatctttttct

SEQ ID NO: 1053 - DNA, 13 bp, Artificial Sequence
  synthetic sequence
ccgccatgttctg

SEQ ID NO: 1054 - DNA, 13 bp, Artificial Sequence
  synthetic sequence
gtttgcttttgcc

SEQ ID NO: 1055 - DNA, 13 bp, Artificial Sequence
  synthetic sequence
gttctcgaggtct

SEQ ID NO: 1056 - DNA, 13 bp, Artificial Sequence
  synthetic sequence
gaaactccggcca

SEQ ID NO: 1057 - DNA, 13 bp, Artificial Sequence
  synthetic sequence
aatcccaaagcca

SEQ ID NO: 1058 - DNA, 13 bp, Artificial Sequence
  synthetic sequence
aataacccatatc

SEQ ID NO: 1059 - DNA, 13 bp, Artificial Sequence
  synthetic sequence
tgccaaactctcc

SEQ ID NO: 1060 - DNA, 13 bp, Artificial Sequence
  synthetic sequence
gtaaccactccat

SEQ ID NO: 1061 - DNA, 13 bp, Artificial Sequence
  synthetic sequence
gaccaggttgttc

SEQ ID NO: 1062 - DNA, 13 bp, Artificial Sequence
  synthetic sequence
tcaccactgggtt

SEQ ID NO: 1063 - DNA, 13 bp, Artificial Sequence
  synthetic sequence
ctgtcaggtgctg

SEQ ID NO: 1064 - DNA, 13 bp, Artificial Sequence
  synthetic sequence
tgctctgaggaaa

SEQ ID NO: 1065 - DNA, 13 bp, Artificial Sequence
  synthetic sequence
agcttccatgttc

SEQ ID NO: 1066 - DNA, 13 bp, Artificial Sequence
  synthetic sequence
ctgtgtattcctc

SEQ ID NO: 1067 - DNA, 13 bp, Artificial Sequence
  synthetic sequence
tctcctcttttca

SEQ ID NO: 1068 - DNA, 13 bp, Artificial Sequence
  synthetic sequence
cattggtgttatt

SEQ ID NO: 1069 - DNA, 13 bp, Artificial Sequence
  synthetic sequence
aaatggtgtgaac

SEQ ID NO: 1070 - DNA, 13 bp, Artificial Sequence
  synthetic sequence
caaaaacctggtg

SEQ ID NO: 1071 - DNA, 13 bp, Artificial Sequence
  synthetic sequence
gctgctcttttct

SEQ ID NO: 1072 - DNA, 13 bp, Artificial Sequence
  synthetic sequence
taaatctcttcat

SEQ ID NO: 1073 - DNA, 13 bp, Artificial Sequence
  synthetic sequence
atgtttgccatgg

SEQ ID NO: 1074 - DNA, 13 bp, Artificial Sequence
  synthetic sequence
gccattcccaaga

SEQ ID NO: 1075 - DNA, 13 bp, Artificial Sequence
  synthetic sequence
ctgttgtctgata

SEQ ID NO: 1076 - DNA, 13 bp, Artificial Sequence
  synthetic sequence
ctcctgaccctgc

SEQ ID NO: 1077 - DNA, 13 bp, Artificial Sequence
  synthetic sequence
tatcacacttttc

SEQ ID NO: 1078 - DNA, 13 bp, Artificial Sequence
  synthetic sequence
ccaattcgctggg

SEQ ID NO: 1079 - DNA, 13 bp, Artificial Sequence
  synthetic sequence
ttgctcctgacag

SEQ ID NO: 1080 - DNA, 13 bp, Artificial Sequence
  synthetic sequence
acccagtacatct

SEQ ID NO: 1081 - DNA, 13 bp, Artificial Sequence
  synthetic sequence
ggaaagagagata

SEQ ID NO: 1082 - DNA, 13 bp, Artificial Sequence
  synthetic sequence
ttgctctggggaa

SEQ ID NO: 1083 - DNA, 13 bp, Artificial Sequence
  synthetic sequence
ttacagaactcct

SEQ ID NO: 1084 - DNA, 13 bp, Artificial Sequence
  synthetic sequence
tcaatgctatgtc

SEQ ID NO: 1085 - DNA, 13 bp, Artificial Sequence
  synthetic sequence
cttacctaggtgc

SEQ ID NO: 1086 - DNA, 13 bp, Artificial Sequence
  synthetic sequence
ccgtactatggct

SEQ ID NO: 1087 - DNA, 13 bp, Artificial Sequence
  synthetic sequence
ccttttccaaaca

SEQ ID NO: 1088 - DNA, 13 bp, Artificial Sequence
  synthetic sequence
caattgggttgac

SEQ ID NO: 1089 - DNA, 13 bp, Artificial Sequence
  synthetic sequence
tgataccttattg

SEQ ID NO: 1090 - DNA, 13 bp, Artificial Sequence
  synthetic sequence
ttgtgcagctcac

SEQ ID NO: 1091 - DNA, 13 bp, Artificial Sequence
  synthetic sequence
tttcctgatgaca

SEQ ID NO: 1092 - DNA, 13 bp, Artificial Sequence
  synthetic sequence
ccatccttcataa

SEQ ID NO: 1093 - DNA, 13 bp, Artificial Sequence
  synthetic sequence
cctgttctgggtg

SEQ ID NO: 1094 - DNA, 13 bp, Artificial Sequence
  synthetic sequence
ccatgtcagcatg

SEQ ID NO: 1095 - DNA, 13 bp, Artificial Sequence
  synthetic sequence
tcagctcagtggg

SEQ ID NO: 1096 - DNA, 13 bp, Artificial Sequence
  synthetic sequence
tgttccaaaacct

SEQ ID NO: 1097 - DNA, 13 bp, Artificial Sequence
  synthetic sequence
gtagctcctgtca

SEQ ID NO: 1098 - DNA, 13 bp, Artificial Sequence
  synthetic sequence
ccatggtaagccc

SEQ ID NO: 1099 - DNA, 13 bp, Artificial Sequence
  synthetic sequence
catgatggttcaa

SEQ ID NO: 1100 - DNA, 13 bp, Artificial Sequence
  synthetic sequence
tctgtggaaaggc

SEQ ID NO: 1101 - DNA, 13 bp, Artificial Sequence
  synthetic sequence
acccaatacatct

SEQ ID NO: 1102 - DNA, 13 bp, Artificial Sequence
  synthetic sequence
gcagctgtccttt

SEQ ID NO: 1103 - DNA, 13 bp, Artificial Sequence
  synthetic sequence
gcactcacatatg

SEQ ID NO: 1104 - DNA, 13 bp, Artificial Sequence
  synthetic sequence
cttctgtccagtg

SEQ ID NO: 1105 - DNA, 13 bp, Artificial Sequence
  synthetic sequence
tactgttctgtcc

SEQ ID NO: 1106 - DNA, 13 bp, Artificial Sequence
  synthetic sequence
cgatttcttctgt

SEQ ID NO: 1107 - DNA, 13 bp, Artificial Sequence
  synthetic sequence
tgtgtctcagcat

SEQ ID NO: 1108 - DNA, 13 bp, Artificial Sequence
  synthetic sequence
gacatccacgttt

SEQ ID NO: 1109 - DNA, 13 bp, Artificial Sequence
  synthetic sequence
tcttaaacaagag

SEQ ID NO: 1110 - DNA, 13 bp, Artificial Sequence
  synthetic sequence
tgaagatcatcct

SEQ ID NO: 1111 - DNA, 13 bp, Artificial Sequence
  synthetic sequence
atgatatcatgtc

SEQ ID NO: 1112 - DNA, 13 bp, Artificial Sequence
  synthetic sequence
gctggatgctttt

SEQ ID NO: 1113 - DNA, 13 bp, Artificial Sequence
  synthetic sequence
gaatgagtgtgac

SEQ ID NO: 1114 - DNA, 13 bp, Artificial Sequence
  synthetic sequence
ccatttcagatat

SEQ ID NO: 1115 - DNA, 13 bp, Artificial Sequence
  synthetic sequence
cctcctgccacca

SEQ ID NO: 1116 - DNA, 13 bp, Artificial Sequence
  synthetic sequence
tttctgttgtgtg

SEQ ID NO: 1117 - DNA, 13 bp, Artificial Sequence
  synthetic sequence
cctccatgttcta

SEQ ID NO: 1118 - DNA, 13 bp, Artificial Sequence
  synthetic sequence
ttccatgaatatt

SEQ ID NO: 1119 - DNA, 13 bp, Artificial Sequence
  synthetic sequence
aggttctgtatgg

SEQ ID NO: 1120 - DNA, 13 bp, Artificial Sequence
  synthetic sequence
gttttcacttgcc

SEQ ID NO: 1121 - DNA, 13 bp, Artificial Sequence
  synthetic sequence
ctgttgttccggg

SEQ ID NO: 1122 - DNA, 13 bp, Artificial Sequence
  synthetic sequence
cttctgtggctcc

SEQ ID NO: 1123 - DNA, 13 bp, Artificial Sequence
  synthetic sequence
tgggtttgtagaa

SEQ ID NO: 1124 - DNA, 13 bp, Artificial Sequence
  synthetic sequence
taacggattggca

SEQ ID NO: 1125 - DNA, 13 bp, Artificial Sequence
  synthetic sequence
tgtatcttttcat

SEQ ID NO: 1126 - DNA, 13 bp, Artificial Sequence
  synthetic sequence
actccatttccat

SEQ ID NO: 1127 - DNA, 13 bp, Artificial Sequence
  synthetic sequence
ccattgacactgc

SEQ ID NO: 1128 - DNA, 13 bp, Artificial Sequence
  synthetic sequence
gtgtgatgactcc

SEQ ID NO: 1129 - DNA, 13 bp, Artificial Sequence
  synthetic sequence
ttgaccatgttgt

SEQ ID NO: 1130 - DNA, 13 bp, Artificial Sequence
  synthetic sequence
atcctggtgacat

SEQ ID NO: 1131 - DNA, 13 bp, Artificial Sequence
  synthetic sequence
attctgggttttt

SEQ ID NO: 1132 - DNA, 13 bp, Artificial Sequence
  synthetic sequence
acagtctgggatt

SEQ ID NO: 1133 - DNA, 13 bp, Artificial Sequence
  synthetic sequence
agagtagtccagc

SEQ ID NO: 1134 - DNA, 13 bp, Artificial Sequence
  synthetic sequence
gcctttcctatag

SEQ ID NO: 1135 - DNA, 13 bp, Artificial Sequence
  synthetic sequence
cccatagaaaaag

SEQ ID NO: 1136 - DNA, 13 bp, Artificial Sequence
  synthetic sequence
catgcttgatttt

SEQ ID NO: 1137 - DNA, 13 bp, Artificial Sequence
  synthetic sequence
acattggtctcat

SEQ ID NO: 1138 - DNA, 13 bp, Artificial Sequence
  synthetic sequence
cctagttctttcc

SEQ ID NO: 1139 - DNA, 13 bp, Artificial Sequence
  synthetic sequence
tctcagccaaagg

SEQ ID NO: 1140 - DNA, 13 bp, Artificial Sequence
  synthetic sequence
gccatctgttccg

SEQ ID NO: 1141 - DNA, 13 bp, Artificial Sequence
  synthetic sequence
catagccattgtc

SEQ ID NO: 1142 - DNA, 13 bp, Artificial Sequence
  synthetic sequence
catctcattaaag

SEQ ID NO: 1143 - DNA, 13 bp, Artificial Sequence
  synthetic sequence
gggtatcacattt

SEQ ID NO: 1144 - DNA, 13 bp, Artificial Sequence
  synthetic sequence
attgttgtcgttc

SEQ ID NO: 1145 - DNA, 13 bp, Artificial Sequence
  synthetic sequence
ccgtgattggtat

SEQ ID NO: 1146 - DNA, 13 bp, Artificial Sequence
  synthetic sequence
aaaagattccctc

SEQ ID NO: 1147 - DNA, 13 bp, Artificial Sequence
  synthetic sequence
gtctataggcttt

SEQ ID NO: 1148 - DNA, 13 bp, Artificial Sequence
  synthetic sequence
cccatgtcggcgt

SEQ ID NO: 1149 - DNA, 13 bp, Artificial Sequence
  synthetic sequence
tgtcacacttctc

SEQ ID NO: 1150 - DNA, 13 bp, Artificial Sequence
  synthetic sequence
ctgtgatcagtct

SEQ ID NO: 1151 - DNA, 13 bp, Artificial Sequence
  synthetic sequence
cagccgtatgcag

SEQ ID NO: 1152 - DNA, 13 bp, Artificial Sequence
  synthetic sequence
acataacatgcta

SEQ ID NO: 1153 - DNA, 13 bp, Artificial Sequence
  synthetic sequence
gacatccatgttt

SEQ ID NO: 1154 - DNA, 13 bp, Artificial Sequence
  synthetic sequence
actccattgccat

SEQ ID NO: 1155 - DNA, 13 bp, Artificial Sequence
  synthetic sequence
cttacctagatgc

SEQ ID NO: 1156 - DNA, 13 bp, Artificial Sequence
  synthetic sequence
ccatttcggagat

SEQ ID NO: 1157 - DNA, 13 bp, Artificial Sequence
  synthetic sequence
ttggctgttatca

SEQ ID NO: 1158 - DNA, 13 bp, Artificial Sequence
  synthetic sequence
ccccagcctctat

SEQ ID NO: 1159 - DNA, 13 bp, Artificial Sequence
  synthetic sequence
gttcctctcgaca

SEQ ID NO: 1160 - DNA, 13 bp, Artificial Sequence
  synthetic sequence
tcctctaaaattt

SEQ ID NO: 1161 - DNA, 13 bp, Artificial Sequence
  synthetic sequence
ttcttcacttccc

SEQ ID NO: 1162 - DNA, 13 bp, Artificial Sequence
  synthetic sequence
cacttcccctgac

SEQ ID NO: 1163 - DNA, 13 bp, Artificial Sequence
  synthetic sequence
ccaagaatggctg

SEQ ID NO: 1164 - DNA, 13 bp, Artificial Sequence
  synthetic sequence
attgctcggcttc

SEQ ID NO: 1165 - DNA, 13 bp, Artificial Sequence
  synthetic sequence
gtcgtcatccatt

SEQ ID NO: 1166 - DNA, 13 bp, Artificial Sequence
  synthetic sequence
tggtttgttacca

SEQ ID NO: 1167 - DNA, 13 bp, Artificial Sequence
  synthetic sequence
acttccacatttt

SEQ ID NO: 1168 - DNA, 13 bp, Artificial Sequence
  synthetic sequence
ttttgacactggc

SEQ ID NO: 1169 - DNA, 13 bp, Artificial Sequence
  synthetic sequence
ggcctaatcattt

SEQ ID NO: 1170 - DNA, 13 bp, Artificial Sequence
  synthetic sequence
cggctctgttgtc

SEQ ID NO: 1171 - DNA, 13 bp, Artificial Sequence
  synthetic sequence
gggtggctgttct

SEQ ID NO: 1172 - DNA, 13 bp, Artificial Sequence
  synthetic sequence
gcctttgacagca

SEQ ID NO: 1173 - DNA, 13 bp, Artificial Sequence
  synthetic sequence
caaaaatctggtg

SEQ ID NO: 1174 - DNA, 13 bp, Artificial Sequence
  synthetic sequence
caaattcttggtt

SEQ ID NO: 1175 - DNA, 13 bp, Artificial Sequence
  synthetic sequence
aacagaaggcttt

SEQ ID NO: 1176 - DNA, 13 bp, Artificial Sequence
  synthetic sequence
aagtggtgggagc

SEQ ID NO: 1177 - DNA, 13 bp, Artificial Sequence
  synthetic sequence
agcagcaccatca

SEQ ID NO: 1178 - DNA, 13 bp, Artificial Sequence
  synthetic sequence
tatgggtggtctt

SEQ ID NO: 1179 - DNA, 13 bp, Artificial Sequence
  synthetic sequence
agtacatttcatg

SEQ ID NO: 1180 - DNA, 13 bp, Artificial Sequence
  synthetic sequence
accacgaaatccc

SEQ ID NO: 1181 - DNA, 13 bp, Artificial Sequence
  synthetic sequence
gcgggtatggagt

SEQ ID NO: 1182 - DNA, 13 bp, Artificial Sequence
  synthetic sequence
ctgtaatcaggcg

SEQ ID NO: 1183 - DNA, 13 bp, Artificial Sequence
  synthetic sequence
caaaatccagttc

SEQ ID NO: 1184 - DNA, 13 bp, Artificial Sequence
  synthetic sequence
gcttctgtccaat

SEQ ID NO: 1185 - DNA, 13 bp, Artificial Sequence
  synthetic sequence
tctgacgtgtgca

SEQ ID NO: 1186 - DNA, 13 bp, Artificial Sequence
  synthetic sequence
tgcaaaggttggt

SEQ ID NO: 1187 - DNA, 13 bp, Artificial Sequence
  synthetic sequence
ttatctaggagca

SEQ ID NO: 1188 - DNA, 13 bp, Artificial Sequence
  synthetic sequence
ctctgggggaagg

SEQ ID NO: 1189 - DNA, 13 bp, Artificial Sequence
  synthetic sequence
taagcaacaccat

SEQ ID NO: 1190 - DNA, 13 bp, Artificial Sequence
  synthetic sequence
tctgaaggtcatc

SEQ ID NO: 1191 - DNA, 13 bp, Artificial Sequence
  synthetic sequence
tggtattccagaa

SEQ ID NO: 1192 - DNA, 13 bp, Artificial Sequence
  synthetic sequence
ccagtcccatgcc

SEQ ID NO: 1193 - DNA, 13 bp, Artificial Sequence
  synthetic sequence
ttccaaataatcc

SEQ ID NO: 1194 - DNA, 13 bp, Artificial Sequence
  synthetic sequence
ccccaacctctgt

SEQ ID NO: 1195 - DNA, 13 bp, Artificial Sequence
  synthetic sequence
tcatttcattgaa

SEQ ID NO: 1196 - DNA, 13 bp, Artificial Sequence
  synthetic sequence
cccagggttctcc

SEQ ID NO: 1197 - DNA, 13 bp, Artificial Sequence
  synthetic sequence
ttttcttccagta

SEQ ID NO: 1198 - DNA, 13 bp, Artificial Sequence
  synthetic sequence
aagtggtgtgaac

SEQ ID NO: 1199 - DNA, 13 bp, Artificial Sequence
  synthetic sequence
tctgtggctcctg

SEQ ID NO: 1200 - DNA, 13 bp, Artificial Sequence
  synthetic sequence
cagccgtgtgcag

SEQ ID NO: 1201 - DNA, 13 bp, Artificial Sequence
  synthetic sequence
aatagttgaagtc

SEQ ID NO: 1202 - DNA, 13 bp, Artificial Sequence
  synthetic sequence
ctcagcaaaaggg

SEQ ID NO: 1203 - DNA, 13 bp, Artificial Sequence
  synthetic sequence
tgtcacatttttc

SEQ ID NO: 1204 - DNA, 13 bp, Artificial Sequence
  synthetic sequence
aaaagattccttc

SEQ ID NO: 1205 - DNA, 13 bp, Artificial Sequence
  synthetic sequence
gtcaggcacaaca

SEQ ID NO: 1206 - DNA, 13 bp, Artificial Sequence
  synthetic sequence
aaacagctatcgt

SEQ ID NO: 1207 - DNA, 13 bp, Artificial Sequence
  synthetic sequence
tgtgttatttctc

SEQ ID NO: 1208 - DNA, 13 bp, Artificial Sequence
  synthetic sequence
cagtgagcacgta

SEQ ID NO: 1209 - DNA, 13 bp, Artificial Sequence
  synthetic sequence
ctcatatgatcca

SEQ ID NO: 1210 - DNA, 13 bp, Artificial Sequence
  synthetic sequence
agtcccaatcatt

SEQ ID NO: 1211 - DNA, 13 bp, Artificial Sequence
  synthetic sequence
tactgctctgtcc

SEQ ID NO: 1212 - DNA, 13 bp, Artificial Sequence
  synthetic sequence
cacaagacaccca

SEQ ID NO: 1213 - DNA, 13 bp, Artificial Sequence
  synthetic sequence
gtcagctttctca

SEQ ID NO: 1214 - DNA, 13 bp, Artificial Sequence
  synthetic sequence
tccatgttttctt

SEQ ID NO: 1215 - DNA, 13 bp, Artificial Sequence
  synthetic sequence
catcatgggggtg

SEQ ID NO: 1216 - DNA, 13 bp, Artificial Sequence
  synthetic sequence
catatgcggttcc

SEQ ID NO: 1217 - DNA, 13 bp, Artificial Sequence
  synthetic sequence
acagaagactttt

SEQ ID NO: 1218 - DNA, 13 bp, Artificial Sequence
  synthetic sequence
tgaatcttttcat

SEQ ID NO: 1219 - DNA, 13 bp, Artificial Sequence
  synthetic sequence
tgcccatgtccgg

SEQ ID NO: 1220 - DNA, 13 bp, Artificial Sequence
  synthetic sequence
gcctcgcgacaca

SEQ ID NO: 1221 - DNA, 13 bp, Artificial Sequence
  synthetic sequence
acagcctttccca

SEQ ID NO: 1222 - DNA, 13 bp, Artificial Sequence
  synthetic sequence
caacttcttctgt

SEQ ID NO: 1223 - DNA, 13 bp, Artificial Sequence
  synthetic sequence
tgttccagaacct

SEQ ID NO: 1224 - DNA, 13 bp, Artificial Sequence
  synthetic sequence
tgccttttgcttt

SEQ ID NO: 1225 - DNA, 13 bp, Artificial Sequence
  synthetic sequence
tattgtggtgttc

SEQ ID NO: 1226 - DNA, 13 bp, Artificial Sequence
  synthetic sequence
ttccatgagtatt

SEQ ID NO: 1227 - DNA, 13 bp, Artificial Sequence
  synthetic sequence
gctgtgtaagcac

SEQ ID NO: 1228 - DNA, 13 bp, Artificial Sequence
  synthetic sequence
ctcagcattggtg

SEQ ID NO: 1229 - DNA, 13 bp, Artificial Sequence
  synthetic sequence
tgcaggtcatctt

SEQ ID NO: 1230 - DNA, 13 bp, Artificial Sequence
  synthetic sequence
gatatcttattgg

SEQ ID NO: 1231 - DNA, 13 bp, Artificial Sequence
  synthetic sequence
cctcctgagtttt

SEQ ID NO: 1232 - DNA, 13 bp, Artificial Sequence
  synthetic sequence
gtcatccactggt

SEQ ID NO: 1233 - DNA, 13 bp, Artificial Sequence
  synthetic sequence
tgttacgattggg

SEQ ID NO: 1234 - DNA, 13 bp, Artificial Sequence
  synthetic sequence
gacttttcttctt

SEQ ID NO: 1235 - DNA, 13 bp, Artificial Sequence
  synthetic sequence
tggcactaacgta

SEQ ID NO: 1236 - DNA, 13 bp, Artificial Sequence
  synthetic sequence
gggattttcctct

SEQ ID NO: 1237 - DNA, 13 bp, Artificial Sequence
  synthetic sequence
ctccgtatgaaat

SEQ ID NO: 1238 - DNA, 13 bp, Artificial Sequence
  synthetic sequence
catctgttctgtg

SEQ ID NO: 1239 - DNA, 13 bp, Artificial Sequence
  synthetic sequence
agcaccacgtcaa

SEQ ID NO: 1240 - DNA, 13 bp, Artificial Sequence
  synthetic sequence
ttgaagtgagttt

SEQ ID NO: 1241 - DNA, 13 bp, Artificial Sequence
  synthetic sequence
cccatatcagcat

SEQ ID NO: 1242 - DNA, 13 bp, Artificial Sequence
  synthetic sequence
aaaacgtcaactc

SEQ ID NO: 1243 - DNA, 13 bp, Artificial Sequence
  synthetic sequence
ggagagcactcca

SEQ ID NO: 1244 - DNA, 13 bp, Artificial Sequence
  synthetic sequence
tggccattgtctt

SEQ ID NO: 1245 - DNA, 13 bp, Artificial Sequence
  synthetic sequence
attttagcctcat

SEQ ID NO: 1246 - DNA, 13 bp, Artificial Sequence
  synthetic sequence
tgccccaccctct

SEQ ID NO: 1247 - DNA, 13 bp, Artificial Sequence
  synthetic sequence
gtcgctggtattg

SEQ ID NO: 1248 - DNA, 13 bp, Artificial Sequence
  synthetic sequence
ggttagctgttat

SEQ ID NO: 1249 - DNA, 13 bp, Artificial Sequence
  synthetic sequence
gctggggtttggt

SEQ ID NO: 1250 - DNA, 13 bp, Artificial Sequence
  synthetic sequence
tatccagtacatt

SEQ ID NO: 1251 - DNA, 13 bp, Artificial Sequence
  synthetic sequence
cacctggttgttc

SEQ ID NO: 1252 - DNA, 13 bp, Artificial Sequence
  synthetic sequence
gaccctctggaca

SEQ ID NO: 1253 - DNA, 13 bp, Artificial Sequence
  synthetic sequence
ttctttcaaccct

SEQ ID NO: 1254 - DNA, 13 bp, Artificial Sequence
  synthetic sequence
attcctaatgaaa

SEQ ID NO: 1255 - DNA, 13 bp, Artificial Sequence
  synthetic sequence
catagccgttgtt

SEQ ID NO: 1256 - DNA, 13 bp, Artificial Sequence
  synthetic sequence
attccggacctgg

SEQ ID NO: 1257 - DNA, 13 bp, Artificial Sequence
  synthetic sequence
gatcttcatcatt

SEQ ID NO: 1258 - DNA, 13 bp, Artificial Sequence
  synthetic sequence
tctgtgactgtca

SEQ ID NO: 1259 - DNA, 13 bp, Artificial Sequence
  synthetic sequence
tggtaccttcaca

SEQ ID NO: 1260 - DNA, 13 bp, Artificial Sequence
  synthetic sequence
acctcttcattga

SEQ ID NO: 1261 - DNA, 13 bp, Artificial Sequence
  synthetic sequence
cggacaccactgc

SEQ ID NO: 1262 - DNA, 13 bp, Artificial Sequence
  synthetic sequence
tatgaggaagatt

SEQ ID NO: 1263 - DNA, 13 bp, Artificial Sequence
  synthetic sequence
agattaagaaaaa

SEQ ID NO: 1264 - DNA, 13 bp, Artificial Sequence
  synthetic sequence
tgatgaagattaa

SEQ ID NO: 1265 - DNA, 13 bp, Artificial Sequence
  synthetic sequence
atttcttccatgc

SEQ ID NO: 1266 - DNA, 13 bp, Artificial Sequence
  synthetic sequence
gaggaaaattttg

SEQ ID NO: 1267 - DNA, 13 bp, Artificial Sequence
  synthetic sequence
ggaaaattgcctt

SEQ ID NO: 1268 - DNA, 13 bp, Artificial Sequence
  synthetic sequence
agcaattcaaagt

SEQ ID NO: 1269 - DNA, 13 bp, Artificial Sequence
  synthetic sequence
aagattcacacca

SEQ ID NO: 1270 - DNA, 13 bp, Artificial Sequence
  synthetic sequence
gtatagagtcaga

SEQ ID NO: 1271 - DNA, 13 bp, Artificial Sequence
  synthetic sequence
tacaatcttgcat

SEQ ID NO: 1272 - DNA, 13 bp, Artificial Sequence
  synthetic sequence
tcatgtgctcaaa

SEQ ID NO: 1273 - DNA, 13 bp, Artificial Sequence
  synthetic sequence
ttcttcctgtatg

SEQ ID NO: 1274 - DNA, 13 bp, Artificial Sequence
  synthetic sequence
tggatttcggaac

SEQ ID NO: 1275 - DNA, 13 bp, Artificial Sequence
  synthetic sequence
gctcaagctcgtt

SEQ ID NO: 1276 - DNA, 13 bp, Artificial Sequence
  synthetic sequence
ttcaagagagtgc

SEQ ID NO: 1277 - DNA, 13 bp, Artificial Sequence
  synthetic sequence
gaagcggttcaag

SEQ ID NO: 1278 - DNA, 13 bp, Artificial Sequence
  synthetic sequence
caactgcaaattc

SEQ ID NO: 1279 - DNA, 13 bp, Artificial Sequence
  synthetic sequence
aagagaggccatt

SEQ ID NO: 1280 - DNA, 13 bp, Artificial Sequence
  synthetic sequence
tggtagtaggaga

SEQ ID NO: 1281 - DNA, 13 bp, Artificial Sequence
  synthetic sequence
gagtcatccttgc

SEQ ID NO: 1282 - DNA, 13 bp, Artificial Sequence
  synthetic sequence
acaattccacaag

SEQ ID NO: 1283 - DNA, 13 bp, Artificial Sequence
  synthetic sequence
ttgtacgaagctg

SEQ ID NO: 1284 - DNA, 13 bp, Artificial Sequence
  synthetic sequence
ctagacgaggacg

SEQ ID NO: 1285 - DNA, 13 bp, Artificial Sequence
  synthetic sequence
tgacaattggtgg

SEQ ID NO: 1286 - DNA, 13 bp, Artificial Sequence
  synthetic sequence
atcactttattcg

SEQ ID NO: 1287 - DNA, 13 bp, Artificial Sequence
  synthetic sequence
aaggaacacgcac

SEQ ID NO: 1288 - DNA, 13 bp, Artificial Sequence
  synthetic sequence
tgtaccagtggcg

SEQ ID NO: 1289 - DNA, 13 bp, Artificial Sequence
  synthetic sequence
gcagtattgaaat

SEQ ID NO: 1290 - DNA, 13 bp, Artificial Sequence
  synthetic sequence
gcaatgaattttt

SEQ ID NO: 1291 - DNA, 13 bp, Artificial Sequence
  synthetic sequence
ggacgatacaatc

SEQ ID NO: 1292 - DNA, 13 bp, Artificial Sequence
  synthetic sequence
tttcatcttttct

SEQ ID NO: 1293 - DNA, 13 bp, Artificial Sequence
  synthetic sequence
tcctctaaaagga

SEQ ID NO: 1294 - DNA, 13 bp, Artificial Sequence
  synthetic sequence
cacgtgtcattct

SEQ ID NO: 1295 - DNA, 13 bp, Artificial Sequence
  synthetic sequence
ctggccaagctga

SEQ ID NO: 1296 - DNA, 13 bp, Artificial Sequence
  synthetic sequence
aaacaatctcctc

SEQ ID NO: 1297 - DNA, 13 bp, Artificial Sequence
  synthetic sequence
atctaacatctcc

SEQ ID NO: 1298 - DNA, 13 bp, Artificial Sequence
  synthetic sequence
ggtgagttttcag

SEQ ID NO: 1299 - DNA, 13 bp, Artificial Sequence
  synthetic sequence
tgacaaatgataa

SEQ ID NO: 1300 - DNA, 13 bp, Artificial Sequence
  synthetic sequence
aacaatccaggat

SEQ ID NO: 1301 - DNA, 13 bp, Artificial Sequence
  synthetic sequence
attctcgtcctca

SEQ ID NO: 1302 - DNA, 13 bp, Artificial Sequence
  synthetic sequence
gaggcattcttca

SEQ ID NO: 1303 - DNA, 13 bp, Artificial Sequence
  synthetic sequence
gacacacctaagg

SEQ ID NO: 1304 - DNA, 13 bp, Artificial Sequence
  synthetic sequence
caattgcactcgg

SEQ ID NO: 1305 - DNA, 13 bp, Artificial Sequence
  synthetic sequence
ttaaatataactg

SEQ ID NO: 1306 - DNA, 13 bp, Artificial Sequence
  synthetic sequence
catcagcattcat

SEQ ID NO: 1307 - DNA, 13 bp, Artificial Sequence
  synthetic sequence
agtgacttaagta

SEQ ID NO: 1308 - DNA, 13 bp, Artificial Sequence
  synthetic sequence
acatccgctctcg

SEQ ID NO: 1309 - DNA, 13 bp, Artificial Sequence
  synthetic sequence
cttaacttcattt

SEQ ID NO: 1310 - DNA, 13 bp, Artificial Sequence
  synthetic sequence
ggggacatgctca

SEQ ID NO: 1311 - DNA, 13 bp, Artificial Sequence
  synthetic sequence
taaaagcattacg

SEQ ID NO: 1312 - DNA, 13 bp, Artificial Sequence
  synthetic sequence
tgcagttacctcg

SEQ ID NO: 1313 - DNA, 13 bp, Artificial Sequence
  synthetic sequence
atctcgtatcgct

SEQ ID NO: 1314 - DNA, 13 bp, Artificial Sequence
  synthetic sequence
actaaaagatggg

SEQ ID NO: 1315 - DNA, 13 bp, Artificial Sequence
  synthetic sequence
acagtgacaacac

SEQ ID NO: 1316 - DNA, 13 bp, Artificial Sequence
  synthetic sequence
catgttcgagcac

SEQ ID NO: 1317 - DNA, 13 bp, Artificial Sequence
  synthetic sequence
tagtgcataaatc

SEQ ID NO: 1318 - DNA, 13 bp, Artificial Sequence
  synthetic sequence
aggaagggccgat

SEQ ID NO: 1319 - DNA, 13 bp, Artificial Sequence
  synthetic sequence
gctaactcatata

SEQ ID NO: 1320 - DNA, 13 bp, Artificial Sequence
  synthetic sequence
gatatcaaagtac

SEQ ID NO: 1321 - DNA, 13 bp, Artificial Sequence
  synthetic sequence
tgtaataatcaga

SEQ ID NO: 1322 - DNA, 13 bp, Artificial Sequence
  synthetic sequence
gtcttaatgcaaa

SEQ ID NO: 1323 - DNA, 13 bp, Artificial Sequence
  synthetic sequence
gtttaatctgtgg

SEQ ID NO: 1324 - DNA, 13 bp, Artificial Sequence
  synthetic sequence
gattccaagacaa

SEQ ID NO: 1325 - DNA, 13 bp, Artificial Sequence
  synthetic sequence
atatatggaggcc

SEQ ID NO: 1326 - DNA, 13 bp, Artificial Sequence
  synthetic sequence
tgatacacttgtg

SEQ ID NO: 1327 - DNA, 13 bp, Artificial Sequence
  synthetic sequence
acatcagtggtca

SEQ ID NO: 1328 - DNA, 13 bp, Artificial Sequence
  synthetic sequence
tccggacaacagc

SEQ ID NO: 1329 - DNA, 13 bp, Artificial Sequence
  synthetic sequence
gattgattgatga

SEQ ID NO: 1330 - DNA, 13 bp, Artificial Sequence
  synthetic sequence
attggaaaccagg

SEQ ID NO: 1331 - DNA, 13 bp, Artificial Sequence
  synthetic sequence
cggaacataaatt

SEQ ID NO: 1332 - DNA, 13 bp, Artificial Sequence
  synthetic sequence
ttatcacatcaca

SEQ ID NO: 1333 - DNA, 13 bp, Artificial Sequence
  synthetic sequence
aggctgacagggc

SEQ ID NO: 1334 - DNA, 13 bp, Artificial Sequence
  synthetic sequence
aggcagacccact

SEQ ID NO: 1335 - DNA, 13 bp, Artificial Sequence
  synthetic sequence
ctattgctggagt

SEQ ID NO: 1336 - DNA, 13 bp, Artificial Sequence
  synthetic sequence
acaattcttcgga

SEQ ID NO: 1337 - DNA, 13 bp, Artificial Sequence
  synthetic sequence
aaaatcggggccc

SEQ ID NO: 1338 - DNA, 13 bp, Artificial Sequence
  synthetic sequence
ttgtgtgcgaata

SEQ ID NO: 1339 - DNA, 13 bp, Artificial Sequence
  synthetic sequence
agaacaacctagg

SEQ ID NO: 1340 - DNA, 13 bp, Artificial Sequence
  synthetic sequence
ttgttactgtaat

SEQ ID NO: 1341 - DNA, 13 bp, Artificial Sequence
  synthetic sequence
tctcattgaaatt

SEQ ID NO: 1342 - DNA, 13 bp, Artificial Sequence
  synthetic sequence
tcgggacccattt

SEQ ID NO: 1343 - DNA, 13 bp, Artificial Sequence
  synthetic sequence
ttcagagccatat

SEQ ID NO: 1344 - DNA, 13 bp, Artificial Sequence
  synthetic sequence
catcagtgtgctc

SEQ ID NO: 1345 - DNA, 13 bp, Artificial Sequence
  synthetic sequence
gacacacaaaaag

SEQ ID NO: 1346 - DNA, 13 bp, Artificial Sequence
  synthetic sequence
aaagtcgaaccca

SEQ ID NO: 1347 - DNA, 13 bp, Artificial Sequence
  synthetic sequence
atggctaaagcca

SEQ ID NO: 1348 - DNA, 13 bp, Artificial Sequence
  synthetic sequence
gtgagagtcatct

SEQ ID NO: 1349 - DNA, 13 bp, Artificial Sequence
  synthetic sequence
atagcaacattat

SEQ ID NO: 1350 - DNA, 13 bp, Artificial Sequence
  synthetic sequence
accaggctttcct

SEQ ID NO: 1351 - DNA, 13 bp, Artificial Sequence
  synthetic sequence
tggagttgccaca

SEQ ID NO: 1352 - DNA, 13 bp, Artificial Sequence
  synthetic sequence
gaggctattcaag

SEQ ID NO: 1353 - DNA, 13 bp, Artificial Sequence
  synthetic sequence
gataatgatgata

SEQ ID NO: 1354 - DNA, 13 bp, Artificial Sequence
  synthetic sequence
agtatctactgat

SEQ ID NO: 1355 - DNA, 13 bp, Artificial Sequence
  synthetic sequence
acaggccccacac

SEQ ID NO: 1356 - DNA, 13 bp, Artificial Sequence
  synthetic sequence
ctggcttcaactg

SEQ ID NO: 1357 - DNA, 13 bp, Artificial Sequence
  synthetic sequence
acgagacagaaga

SEQ ID NO: 1358 - DNA, 13 bp, Artificial Sequence
  synthetic sequence
atgccttagtctg

SEQ ID NO: 1359 - DNA, 13 bp, Artificial Sequence
  synthetic sequence
ttagcctactcca

SEQ ID NO: 1360 - DNA, 13 bp, Artificial Sequence
  synthetic sequence
taacttcaacagt

SEQ ID NO: 1361 - DNA, 13 bp, Artificial Sequence
  synthetic sequence
tcctcaccgacca

SEQ ID NO: 1362 - DNA, 13 bp, Artificial Sequence
  synthetic sequence
ttattctccacga

SEQ ID NO: 1363 - DNA, 13 bp, Artificial Sequence
  synthetic sequence
tcgtacaatgtgc

SEQ ID NO: 1364 - DNA, 13 bp, Artificial Sequence
  synthetic sequence
gtgccgactgcac

SEQ ID NO: 1365 - DNA, 13 bp, Artificial Sequence
  synthetic sequence
ctcactgatcaag

SEQ ID NO: 1366 - DNA, 13 bp, Artificial Sequence
  synthetic sequence
acttgcttaggaa

SEQ ID NO: 1367 - DNA, 13 bp, Artificial Sequence
  synthetic sequence
gttccaaaccaca

SEQ ID NO: 1368 - DNA, 13 bp, Artificial Sequence
  synthetic sequence
caacagtctgaag

SEQ ID NO: 1369 - DNA, 13 bp, Artificial Sequence
  synthetic sequence
agtatatacgatt

SEQ ID NO: 1370 - DNA, 13 bp, Artificial Sequence
  synthetic sequence
tctgtgcaaaact

SEQ ID NO: 1371 - DNA, 13 bp, Artificial Sequence
  synthetic sequence
ctaagattcaact

SEQ ID NO: 1372 - DNA, 13 bp, Artificial Sequence
  synthetic sequence
ttttatttgggta

SEQ ID NO: 1373 - DNA, 13 bp, Artificial Sequence
  synthetic sequence
tgcaactgcccac

SEQ ID NO: 1374 - DNA, 13 bp, Artificial Sequence
  synthetic sequence
ttgatctcttcaa

SEQ ID NO: 1375 - DNA, 13 bp, Artificial Sequence
  synthetic sequence
gccagttgctctt

SEQ ID NO: 1376 - DNA, 13 bp, Artificial Sequence
  synthetic sequence
aaatcatgcaaca

SEQ ID NO: 1377 - DNA, 13 bp, Artificial Sequence
  synthetic sequence
tggatcacaggat

SEQ ID NO: 1378 - DNA, 13 bp, Artificial Sequence
  synthetic sequence
gacaagatccatt

SEQ ID NO: 1379 - DNA, 13 bp, Artificial Sequence
  synthetic sequence
ggtcttctgattg

SEQ ID NO: 1380 - DNA, 13 bp, Artificial Sequence
  synthetic sequence
ttaattacaaggg

SEQ ID NO: 1381 - DNA, 13 bp, Artificial Sequence
  synthetic sequence
tagtcaatatgtt

SEQ ID NO: 1382 - DNA, 13 bp, Artificial Sequence
  synthetic sequence
cctcctgcaccag

SEQ ID NO: 1383 - DNA, 13 bp, Artificial Sequence
  synthetic sequence
cctctcctccaat

SEQ ID NO: 1384 - DNA, 13 bp, Artificial Sequence
  synthetic sequence
ttgctactgaaca

SEQ ID NO: 1385 - DNA, 13 bp, Artificial Sequence
  synthetic sequence
cttaagatatatg

SEQ ID NO: 1386 - DNA, 13 bp, Artificial Sequence
  synthetic sequence
gtgggtcgtattg

SEQ ID NO: 1387 - DNA, 13 bp, Artificial Sequence
  synthetic sequence
taagtattaagaa

SEQ ID NO: 1388 - DNA, 13 bp, Artificial Sequence
  synthetic sequence
ttgagctttgttg

SEQ ID NO: 1389 - DNA, 13 bp, Artificial Sequence
  synthetic sequence
tatacaggaagaa

SEQ ID NO: 1390 - DNA, 13 bp, Artificial Sequence
  synthetic sequence
aggtatgaattca

SEQ ID NO: 1391 - DNA, 13 bp, Artificial Sequence
  synthetic sequence
atgtccctgtagc

SEQ ID NO: 1392 - DNA, 13 bp, Artificial Sequence
  synthetic sequence
tggatcaactgat

SEQ ID NO: 1393 - DNA, 13 bp, Artificial Sequence
  synthetic sequence
actataggaaata

SEQ ID NO: 1394 - DNA, 13 bp, Artificial Sequence
  synthetic sequence
actgcaacttatc

SEQ ID NO: 1395 - DNA, 13 bp, Artificial Sequence
  synthetic sequence
tacccaaacttgt

SEQ ID NO: 1396 - DNA, 13 bp, Artificial Sequence
  synthetic sequence
cttggacaattgg

SEQ ID NO: 1397 - DNA, 13 bp, Artificial Sequence
  synthetic sequence
tgactcttccaat

SEQ ID NO: 1398 - DNA, 13 bp, Artificial Sequence
  synthetic sequence
cctgggtcactca

SEQ ID NO: 1399 - DNA, 13 bp, Artificial Sequence
  synthetic sequence
gcaagcaattttt

SEQ ID NO: 1400 - DNA, 13 bp, Artificial Sequence
  synthetic sequence
tgtgtcaatttat

SEQ ID NO: 1401 - DNA, 13 bp, Artificial Sequence
  synthetic sequence
ctaagggtttacc

SEQ ID NO: 1402 - DNA, 13 bp, Artificial Sequence
  synthetic sequence
gagtatttgtttc

SEQ ID NO: 1403 - DNA, 13 bp, Artificial Sequence
  synthetic sequence
ctcaatcactcaa

SEQ ID NO: 1404 - DNA, 13 bp, Artificial Sequence
  synthetic sequence
gccaaaatatttc

SEQ ID NO: 1405 - DNA, 13 bp, Artificial Sequence
  synthetic sequence
aaaagtaggtcca

SEQ ID NO: 1406 - DNA, 13 bp, Artificial Sequence
  synthetic sequence
acagaggtgtttg

SEQ ID NO: 1407 - DNA, 13 bp, Artificial Sequence
  synthetic sequence
gaaccagaacttt

SEQ ID NO: 1408 - DNA, 13 bp, Artificial Sequence
  synthetic sequence
tgaagaaagccgc

SEQ ID NO: 1409 - DNA, 13 bp, Artificial Sequence
  synthetic sequence
acttttatgttta

SEQ ID NO: 1410 - DNA, 13 bp, Artificial Sequence
  synthetic sequence
caaaaacagatat

SEQ ID NO: 1411 - DNA, 13 bp, Artificial Sequence
  synthetic sequence
ggcctcagcattc

SEQ ID NO: 1412 - DNA, 13 bp, Artificial Sequence
  synthetic sequence
tacatgtgtagtc

SEQ ID NO: 1413 - DNA, 13 bp, Artificial Sequence
  synthetic sequence
atgtttctgatct

SEQ ID NO: 1414 - DNA, 13 bp, Artificial Sequence
  synthetic sequence
cataagcttataa

SEQ ID NO: 1415 - DNA, 13 bp, Artificial Sequence
  synthetic sequence
ctctcccaatcaa

SEQ ID NO: 1416 - DNA, 13 bp, Artificial Sequence
  synthetic sequence
ccctgaatcgcag

SEQ ID NO: 1417 - DNA, 13 bp, Artificial Sequence
  synthetic sequence
ggcaatttaattg

SEQ ID NO: 1418 - DNA, 13 bp, Artificial Sequence
  synthetic sequence
ccgaagccatcac

SEQ ID NO: 1419 - DNA, 13 bp, Artificial Sequence
  synthetic sequence
caattgccccgtg

SEQ ID NO: 1420 - DNA, 13 bp, Artificial Sequence
  synthetic sequence
cggattaaatgtt

SEQ ID NO: 1421 - DNA, 13 bp, Artificial Sequence
  synthetic sequence
atgagtttacagc

SEQ ID NO: 1422 - DNA, 13 bp, Artificial Sequence
  synthetic sequence
ttgtggaggaggt

SEQ ID NO: 1423 - DNA, 13 bp, Artificial Sequence
  synthetic sequence
tgtgcacaaatct

SEQ ID NO: 1424 - DNA, 13 bp, Artificial Sequence
  synthetic sequence
agctgcaacaatt

SEQ ID NO: 1425 - DNA, 13 bp, Artificial Sequence
  synthetic sequence
aggaaatcaagcc

SEQ ID NO: 1426 - DNA, 13 bp, Artificial Sequence
  synthetic sequence
ggacgagcttttg

SEQ ID NO: 1427 - DNA, 13 bp, Artificial Sequence
  synthetic sequence
tttctgcaattgc

SEQ ID NO: 1428 - DNA, 13 bp, Artificial Sequence
  synthetic sequence
ttctttttgacct

SEQ ID NO: 1429 - DNA, 13 bp, Artificial Sequence
  synthetic sequence
aagggactagaac

SEQ ID NO: 1430 - DNA, 13 bp, Artificial Sequence
  synthetic sequence
tgctcaaattaca

SEQ ID NO: 1431 - DNA, 13 bp, Artificial Sequence
  synthetic sequence
aacaaaagactca

SEQ ID NO: 1432 - DNA, 13 bp, Artificial Sequence
  synthetic sequence
gttgtcggagaaa

SEQ ID NO: 1433 - DNA, 13 bp, Artificial Sequence
  synthetic sequence
gagaattttcagg

SEQ ID NO: 1434 - DNA, 13 bp, Artificial Sequence
  synthetic sequence
taaaagcattgcg

SEQ ID NO: 1435 - DNA, 13 bp, Artificial Sequence
  synthetic sequence
taatgcacaatca

SEQ ID NO: 1436 - DNA, 13 bp, Artificial Sequence
  synthetic sequence
agatagcacaagt

SEQ ID NO: 1437 - DNA, 13 bp, Artificial Sequence
  synthetic sequence
ctatgctcatttc

SEQ ID NO: 1438 - DNA, 13 bp, Artificial Sequence
  synthetic sequence
caaccccgtcgac

SEQ ID NO: 1439 - DNA, 13 bp, Artificial Sequence
  synthetic sequence
gctcgcttttcag

SEQ ID NO: 1440 - DNA, 13 bp, Artificial Sequence
  synthetic sequence
cgtcatccaatga

SEQ ID NO: 1441 - DNA, 13 bp, Artificial Sequence
  synthetic sequence
agagcccaggatc

SEQ ID NO: 1442 - DNA, 13 bp, Artificial Sequence
  synthetic sequence
atggaggaacaaa

SEQ ID NO: 1443 - DNA, 13 bp, Artificial Sequence
  synthetic sequence
actcaccaacacc

SEQ ID NO: 1444 - DNA, 13 bp, Artificial Sequence
  synthetic sequence
ttgacgatcatga

SEQ ID NO: 1445 - DNA, 13 bp, Artificial Sequence
  synthetic sequence
atccaagacatgg

SEQ ID NO: 1446 - DNA, 13 bp, Artificial Sequence
  synthetic sequence
cgtttattctagt

SEQ ID NO: 1447 - DNA, 13 bp, Artificial Sequence
  synthetic sequence
tttttcttaatct

SEQ ID NO: 1448 - DNA, 13 bp, Artificial Sequence
  synthetic sequence
gctggaagctgat

SEQ ID NO: 1449 - DNA, 13 bp, Artificial Sequence
  synthetic sequence
accatgtgcatcc

SEQ ID NO: 1450 - DNA, 13 bp, Artificial Sequence
  synthetic sequence
aatcagttacaaa

SEQ ID NO: 1451 - DNA, 13 bp, Artificial Sequence
  synthetic sequence
cttcaaaggcctg

SEQ ID NO: 1452 - DNA, 13 bp, Artificial Sequence
  synthetic sequence
tggtaaaattccc

SEQ ID NO: 1453 - DNA, 13 bp, Artificial Sequence
  synthetic sequence
ccatgctcaagat

SEQ ID NO: 1454 - DNA, 13 bp, Artificial Sequence
  synthetic sequence
tgggattttgaga

SEQ ID NO: 1455 - DNA, 13 bp, Artificial Sequence
  synthetic sequence
ccccagtgttttt

SEQ ID NO: 1456 - DNA, 13 bp, Artificial Sequence
  synthetic sequence
atataaggtttga

SEQ ID NO: 1457 - DNA, 13 bp, Artificial Sequence
  synthetic sequence
tttgaaataaatg

SEQ ID NO: 1458 - DNA, 13 bp, Artificial Sequence
  synthetic sequence
cttggtatttctg

SEQ ID NO: 1459 - DNA, 13 bp, Artificial Sequence
  synthetic sequence
aaggacattttgg

SEQ ID NO: 1460 - DNA, 13 bp, Artificial Sequence
  synthetic sequence
agatggttttggt

SEQ ID NO: 1461 - DNA, 13 bp, Artificial Sequence
  synthetic sequence
gttcttaaccctg

SEQ ID NO: 1462 - DNA, 13 bp, Artificial Sequence
  synthetic sequence
atcgcgttgctga

SEQ ID NO: 1463 - DNA, 13 bp, Artificial Sequence
  synthetic sequence
aacttgagaatat

SEQ ID NO: 1464 - DNA, 13 bp, Artificial Sequence
  synthetic sequence
ctctgtcacctgc

SEQ ID NO: 1465 - DNA, 13 bp, Artificial Sequence
  synthetic sequence
cgtgaggatgtac

SEQ ID NO: 1466 - DNA, 13 bp, Artificial Sequence
  synthetic sequence
ctcgaatctctgc

SEQ ID NO: 1467 - DNA, 13 bp, Artificial Sequence
  synthetic sequence
ccgttttccgagt

SEQ ID NO: 1468 - DNA, 13 bp, Artificial Sequence
  synthetic sequence
ccctaacactttg

SEQ ID NO: 1469 - DNA, 13 bp, Artificial Sequence
  synthetic sequence
agttgcgtagttg

SEQ ID NO: 1470 - DNA, 13 bp, Artificial Sequence
  synthetic sequence
tgtttatattctc

SEQ ID NO: 1471 - DNA, 13 bp, Artificial Sequence
  synthetic sequence
ataatgtaaagaa

SEQ ID NO: 1472 - DNA, 13 bp, Artificial Sequence
  synthetic sequence
gtgtggctccaat

SEQ ID NO: 1473 - DNA, 13 bp, Artificial Sequence
  synthetic sequence
tttcattgatttg

SEQ ID NO: 1474 - DNA, 13 bp, Artificial Sequence
  synthetic sequence
tgtcataaatcaa

SEQ ID NO: 1475 - DNA, 13 bp, Artificial Sequence
  synthetic sequence
tcgtaatgcgttg

SEQ ID NO: 1476 - DNA, 13 bp, Artificial Sequence
  synthetic sequence
cctctttttcagt

SEQ ID NO: 1477 - DNA, 13 bp, Artificial Sequence
  synthetic sequence
ttgggataagtta

SEQ ID NO: 1478 - DNA, 13 bp, Artificial Sequence
  synthetic sequence
acctccgcattaa

SEQ ID NO: 1479 - DNA, 13 bp, Artificial Sequence
  synthetic sequence
tcattagctgctc

SEQ ID NO: 1480 - DNA, 13 bp, Artificial Sequence
  synthetic sequence
catcaacacagtc

SEQ ID NO: 1481 - DNA, 13 bp, Artificial Sequence
  synthetic sequence
aaactttgcattc

SEQ ID NO: 1482 - DNA, 13 bp, Artificial Sequence
  synthetic sequence
ccgttcagtgcca

SEQ ID NO: 1483 - DNA, 13 bp, Artificial Sequence
  synthetic sequence
ttcccagggttct

SEQ ID NO: 1484 - DNA, 13 bp, Artificial Sequence
  synthetic sequence
gcatggcagcaag

SEQ ID NO: 1485 - DNA, 13 bp, Artificial Sequence
  synthetic sequence
agtttttcttaat

SEQ ID NO: 1486 - DNA, 13 bp, Artificial Sequence
  synthetic sequence
tttgcaatcgctt

SEQ ID NO: 1487 - DNA, 13 bp, Artificial Sequence
  synthetic sequence
agtccttcaatcc

SEQ ID NO: 1488 - DNA, 13 bp, Artificial Sequence
  synthetic sequence
ggtagtagatact

SEQ ID NO: 1489 - DNA, 13 bp, Artificial Sequence
  synthetic sequence
tgatgatattgca

SEQ ID NO: 1490 - DNA, 13 bp, Artificial Sequence
  synthetic sequence
gaatgctgtctgg

SEQ ID NO: 1491 - DNA, 13 bp, Artificial Sequence
  synthetic sequence
gatgtgtacagac

SEQ ID NO: 1492 - DNA, 13 bp, Artificial Sequence
  synthetic sequence
gtcttgcttggtg

SEQ ID NO: 1493 - DNA, 13 bp, Artificial Sequence
  synthetic sequence
agtaattccctat

SEQ ID NO: 1494 - DNA, 13 bp, Artificial Sequence
  synthetic sequence
tttttagtttccc

SEQ ID NO: 1495 - DNA, 13 bp, Artificial Sequence
  synthetic sequence
tccaagtcacact

SEQ ID NO: 1496 - DNA, 13 bp, Artificial Sequence
  synthetic sequence
gtaaaagaatggg

SEQ ID NO: 1497 - DNA, 13 bp, Artificial Sequence
  synthetic sequence
agcacaatggttc

SEQ ID NO: 1498 - DNA, 13 bp, Artificial Sequence
  synthetic sequence
ttgtagaatcaag

SEQ ID NO: 1499 - DNA, 13 bp, Artificial Sequence
  synthetic sequence
gagattcagtcca

SEQ ID NO: 1500 - DNA, 13 bp, Artificial Sequence
  synthetic sequence
aatcacttttatt

SEQ ID NO: 1501 - DNA, 13 bp, Artificial Sequence
  synthetic sequence
aattagggcacat

SEQ ID NO: 1502 - DNA, 13 bp, Artificial Sequence
  synthetic sequence
atggtatccaggc

SEQ ID NO: 1503 - DNA, 13 bp, Artificial Sequence
  synthetic sequence
caacctcgaacaa

SEQ ID NO: 1504 - DNA, 13 bp, Artificial Sequence
  synthetic sequence
gaatgtacaaatg

SEQ ID NO: 1505 - DNA, 13 bp, Artificial Sequence
  synthetic sequence
gatcaattttgtc

SEQ ID NO: 1506 - DNA, 13 bp, Artificial Sequence
  synthetic sequence
aagcacctttagt

SEQ ID NO: 1507 - DNA, 13 bp, Artificial Sequence
  synthetic sequence
ttcctgatacttt

SEQ ID NO: 1508 - DNA, 13 bp, Artificial Sequence
  synthetic sequence
ttgtaagggtgtc

SEQ ID NO: 1509 - DNA, 13 bp, Artificial Sequence
  synthetic sequence
tgtggcaagggtt

SEQ ID NO: 1510 - DNA, 13 bp, Artificial Sequence
  synthetic sequence
tgctcaacgttta

SEQ ID NO: 1511 - DNA, 13 bp, Artificial Sequence
  synthetic sequence
ggtgatgagtgtt

SEQ ID NO: 1512 - DNA, 13 bp, Artificial Sequence
  synthetic sequence
tttcttctgtcat

SEQ ID NO: 1513 - DNA, 13 bp, Artificial Sequence
  synthetic sequence
ttagggttgttga

SEQ ID NO: 1514 - DNA, 13 bp, Artificial Sequence
  synthetic sequence
ggtcctgatcttg

SEQ ID NO: 1515 - DNA, 13 bp, Artificial Sequence
  synthetic sequence
tctttcggaggga

SEQ ID NO: 1516 - DNA, 13 bp, Artificial Sequence
  synthetic sequence
caacttgagttgc

SEQ ID NO: 1517 - DNA, 13 bp, Artificial Sequence
  synthetic sequence
gactcctttcgtt

SEQ ID NO: 1518 - DNA, 13 bp, Artificial Sequence
  synthetic sequence
caatatccttcta

SEQ ID NO: 1519 - DNA, 13 bp, Artificial Sequence
  synthetic sequence
tttttcttaacct

SEQ ID NO: 1520 - DNA, 13 bp, Artificial Sequence
  synthetic sequence
gtgttatcaacca

SEQ ID NO: 1521 - DNA, 13 bp, Artificial Sequence
  synthetic sequence
ttactagacaaaa

SEQ ID NO: 1522 - DNA, 13 bp, Artificial Sequence
  synthetic sequence
aaatttttgtgtg

SEQ ID NO: 1523 - DNA, 13 bp, Artificial Sequence
  synthetic sequence
cttaattatcatt

SEQ ID NO: 1524 - DNA, 13 bp, Artificial Sequence
  synthetic sequence
atcctttttgcaa

SEQ ID NO: 1525 - DNA, 13 bp, Artificial Sequence
  synthetic sequence
tatcatacctctt

SEQ ID NO: 1526 - DNA, 13 bp, Artificial Sequence
  synthetic sequence
tgaagcttatttt

SEQ ID NO: 1527 - DNA, 13 bp, Artificial Sequence
  synthetic sequence
ggacacacaaaaa

SEQ ID NO: 1528 - DNA, 13 bp, Artificial Sequence
  synthetic sequence
tgtattgtgaatt

SEQ ID NO: 1529 - DNA, 13 bp, Artificial Sequence
  synthetic sequence
gtttcagcatcca

SEQ ID NO: 1530 - DNA, 13 bp, Artificial Sequence
  synthetic sequence
tatctagtctgct

SEQ ID NO: 1531 - DNA, 13 bp, Artificial Sequence
  synthetic sequence
tttttattttccc

SEQ ID NO: 1532 - DNA, 13 bp, Artificial Sequence
  synthetic sequence
gaccaagtcgatt

SEQ ID NO: 1533 - DNA, 13 bp, Artificial Sequence
  synthetic sequence
gtctcctcttcag

SEQ ID NO: 1534 - DNA, 13 bp, Artificial Sequence
  synthetic sequence
acaaagtcaattg

SEQ ID NO: 1535 - DNA, 13 bp, Artificial Sequence
  synthetic sequence
ctaaatagttatt

SEQ ID NO: 1536 - DNA, 13 bp, Artificial Sequence
  synthetic sequence
tgtccaatcatgt

SEQ ID NO: 1537 - DNA, 13 bp, Artificial Sequence
  synthetic sequence
agattggctcaaa

SEQ ID NO: 1538 - DNA, 13 bp, Artificial Sequence
  synthetic sequence
tgttgaactccat

SEQ ID NO: 1539 - DNA, 13 bp, Artificial Sequence
  synthetic sequence
ttgactccagaaa

SEQ ID NO: 1540 - DNA, 13 bp, Artificial Sequence
  synthetic sequence
tccgttttgttat

SEQ ID NO: 1541 - DNA, 13 bp, Artificial Sequence
  synthetic sequence
aagcaatgacaat

SEQ ID NO: 1542 - DNA, 13 bp, Artificial Sequence
  synthetic sequence
taccagtcagttg

SEQ ID NO: 1543 - DNA, 13 bp, Artificial Sequence
  synthetic sequence
ggatgcccccaat

SEQ ID NO: 1544 - DNA, 13 bp, Artificial Sequence
  synthetic sequence
tgatagaattccc

SEQ ID NO: 1545 - DNA, 13 bp, Artificial Sequence
  synthetic sequence
cctgagtgtacga

SEQ ID NO: 1546 - DNA, 13 bp, Artificial Sequence
  synthetic sequence
aaccgctgttgtt

SEQ ID NO: 1547 - DNA, 13 bp, Artificial Sequence
  synthetic sequence
ttccttgggcttt

SEQ ID NO: 1548 - DNA, 13 bp, Artificial Sequence
  synthetic sequence
agtacgggatcca

SEQ ID NO: 1549 - DNA, 13 bp, Artificial Sequence
  synthetic sequence
gagcaccaaaatt

SEQ ID NO: 1550 - DNA, 13 bp, Artificial Sequence
  synthetic sequence
ctgtcgaattctg

SEQ ID NO: 1551 - DNA, 13 bp, Artificial Sequence
  synthetic sequence
tcagctggtcagt

SEQ ID NO: 1552 - DNA, 13 bp, Artificial Sequence
  synthetic sequence
tggtggagatctg

SEQ ID NO: 1553 - DNA, 13 bp, Artificial Sequence
  synthetic sequence
ggtgatgatgttg

SEQ ID NO: 1554 - DNA, 13 bp, Artificial Sequence
  synthetic sequence
tcaatgccttaat

SEQ ID NO: 1555 - DNA, 13 bp, Artificial Sequence
  synthetic sequence
atatgttttggta

SEQ ID NO: 1556 - DNA, 13 bp, Artificial Sequence
  synthetic sequence
ggaaccttctcat

SEQ ID NO: 1557 - DNA, 13 bp, Artificial Sequence
  synthetic sequence
gtggatgaagatt

SEQ ID NO: 1558 - DNA, 13 bp, Artificial Sequence
  synthetic sequence
ttgaacaagtgtg

SEQ ID NO: 1559 - DNA, 13 bp, Artificial Sequence
  synthetic sequence
atcctcgtagtca

SEQ ID NO: 1560 - DNA, 13 bp, Artificial Sequence
  synthetic sequence
tatgaactagggc

SEQ ID NO: 1561 - DNA, 13 bp, Artificial Sequence
  synthetic sequence
gaagtagaacggg

SEQ ID NO: 1562 - DNA, 13 bp, Artificial Sequence
  synthetic sequence
gattttgtggact

SEQ ID NO: 1563 - DNA, 13 bp, Artificial Sequence
  synthetic sequence
atctagatttagc

SEQ ID NO: 1564 - DNA, 13 bp, Artificial Sequence
  synthetic sequence
tcacctgcagtcc

SEQ ID NO: 1565 - DNA, 13 bp, Artificial Sequence
  synthetic sequence
gattattttgtac

SEQ ID NO: 1566 - DNA, 13 bp, Artificial Sequence
  synthetic sequence
gagcttatttata

SEQ ID NO: 1567 - DNA, 13 bp, Artificial Sequence
  synthetic sequence
agatttgaagagc

SEQ ID NO: 1568 - DNA, 13 bp, Artificial Sequence
  synthetic sequence
gaagcccctcaat

SEQ ID NO: 1569 - DNA, 13 bp, Artificial Sequence
  synthetic sequence
gtctgtgacaaaa

SEQ ID NO: 1570 - DNA, 13 bp, Artificial Sequence
  synthetic sequence
tgttttgatttct

SEQ ID NO: 1571 - DNA, 13 bp, Artificial Sequence
  synthetic sequence
gattctggggcaa

SEQ ID NO: 1572 - DNA, 13 bp, Artificial Sequence
  synthetic sequence
ttatgaccatagt

SEQ ID NO: 1573 - DNA, 13 bp, Artificial Sequence
  synthetic sequence
ttgtaatcttttc

SEQ ID NO: 1574 - DNA, 13 bp, Artificial Sequence
  synthetic sequence
gttgctgtgttac

SEQ ID NO: 1575 - DNA, 13 bp, Artificial Sequence
  synthetic sequence
ccctattaactgt

SEQ ID NO: 1576 - DNA, 13 bp, Artificial Sequence
  synthetic sequence
tgctgagtagttc

SEQ ID NO: 1577 - DNA, 13 bp, Artificial Sequence
  synthetic sequence
accagataacgat

SEQ ID NO: 1578 - DNA, 13 bp, Artificial Sequence
  synthetic sequence
atcgcaaaatgag

SEQ ID NO: 1579 - DNA, 13 bp, Artificial Sequence
  synthetic sequence
aattgcaatttag

SEQ ID NO: 1580 - DNA, 13 bp, Artificial Sequence
  synthetic sequence
gaatttccgcact

SEQ ID NO: 1581 - DNA, 13 bp, Artificial Sequence
  synthetic sequence
ggcttaatagcgg

SEQ ID NO: 1582 - DNA, 13 bp, Artificial Sequence
  synthetic sequence
cttcttaacgccg

SEQ ID NO: 1583 - DNA, 13 bp, Artificial Sequence
  synthetic sequence
gattataatcagt

SEQ ID NO: 1584 - DNA, 13 bp, Artificial Sequence
  synthetic sequence
ttactccttcctg

SEQ ID NO: 1585 - DNA, 13 bp, Artificial Sequence
  synthetic sequence
gcctgatatcact

SEQ ID NO: 1586 - DNA, 13 bp, Artificial Sequence
  synthetic sequence
tttcagaaccttg

SEQ ID NO: 1587 - DNA, 13 bp, Artificial Sequence
  synthetic sequence
cagaaaaccagcc

SEQ ID NO: 1588 - DNA, 13 bp, Artificial Sequence
  synthetic sequence
taagaagtgggtt

SEQ ID NO: 1589 - DNA, 13 bp, Artificial Sequence
  synthetic sequence
attgccttgtggt

SEQ ID NO: 1590 - DNA, 13 bp, Artificial Sequence
  synthetic sequence
atggaatcttagg

SEQ ID NO: 1591 - DNA, 13 bp, Artificial Sequence
  synthetic sequence
ccttggactatct

SEQ ID NO: 1592 - DNA, 13 bp, Artificial Sequence
  synthetic sequence
ttacagggatact

SEQ ID NO: 1593 - DNA, 13 bp, Artificial Sequence
  synthetic sequence
tcccatagtatat

SEQ ID NO: 1594 - DNA, 13 bp, Artificial Sequence
  synthetic sequence
atcttaaaaacaa

SEQ ID NO: 1595 - DNA, 13 bp, Artificial Sequence
  synthetic sequence
cttgcatattgtt

SEQ ID NO: 1596 - DNA, 13 bp, Artificial Sequence
  synthetic sequence
agatatgtttcgg

SEQ ID NO: 1597 - DNA, 13 bp, Artificial Sequence
  synthetic sequence
tcccgttcggatc

SEQ ID NO: 1598 - DNA, 13 bp, Artificial Sequence
  synthetic sequence
ttaagctggcctc

SEQ ID NO: 1599 - DNA, 13 bp, Artificial Sequence
  synthetic sequence
ttaattttcctgg

SEQ ID NO: 1600 - DNA, 13 bp, Artificial Sequence
  synthetic sequence
tagaaatgtatca

SEQ ID NO: 1601 - DNA, 13 bp, Artificial Sequence
  synthetic sequence
agatgaaggtaag

SEQ ID NO: 1602 - DNA, 13 bp, Artificial Sequence
  synthetic sequence
atttgagaaggag

SEQ ID NO: 1603 - DNA, 13 bp, Artificial Sequence
  synthetic sequence
gtctcatctggtt

SEQ ID NO: 1604 - DNA, 13 bp, Artificial Sequence
  synthetic sequence
gctaccatatgca

SEQ ID NO: 1605 - DNA, 13 bp, Artificial Sequence
  synthetic sequence
gcactattccatc

SEQ ID NO: 1606 - DNA, 13 bp, Artificial Sequence
  synthetic sequence
tgcggagtttatt

SEQ ID NO: 1607 - DNA, 13 bp, Artificial Sequence
  synthetic sequence
gtatgtgtgccca

SEQ ID NO: 1608 - DNA, 13 bp, Artificial Sequence
  synthetic sequence
gataccagtcctt

SEQ ID NO: 1609 - DNA, 13 bp, Artificial Sequence
  synthetic sequence
aatgtttgcattt

SEQ ID NO: 1610 - DNA, 13 bp, Artificial Sequence
  synthetic sequence
gctgcccaatctt

SEQ ID NO: 1611 - DNA, 13 bp, Artificial Sequence
  synthetic sequence
catgatgactgtg

SEQ ID NO: 1612 - DNA, 13 bp, Artificial Sequence
  synthetic sequence
agacctctactgt

SEQ ID NO: 1613 - DNA, 13 bp, Artificial Sequence
  synthetic sequence
caattatgcatat

SEQ ID NO: 1614 - DNA, 13 bp, Artificial Sequence
  synthetic sequence
acacctaatctct

SEQ ID NO: 1615 - DNA, 13 bp, Artificial Sequence
  synthetic sequence
tataaccttctga

SEQ ID NO: 1616 - DNA, 13 bp, Artificial Sequence
  synthetic sequence
gacaatgtaaaaa

SEQ ID NO: 1617 - DNA, 13 bp, Artificial Sequence
  synthetic sequence
ctgaaataacaac

SEQ ID NO: 1618 - DNA, 13 bp, Artificial Sequence
  synthetic sequence
tgcctctaacagt

SEQ ID NO: 1619 - DNA, 13 bp, Artificial Sequence
  synthetic sequence
acctgtagagacc

SEQ ID NO: 1620 - DNA, 13 bp, Artificial Sequence
  synthetic sequence
cccttaggatggg

SEQ ID NO: 1621 - DNA, 13 bp, Artificial Sequence
  synthetic sequence
agtgtataatata

SEQ ID NO: 1622 - DNA, 13 bp, Artificial Sequence
  synthetic sequence
ttctgcgagtaga

SEQ ID NO: 1623 - DNA, 13 bp, Artificial Sequence
  synthetic sequence
ttgtcagtaatgt

SEQ ID NO: 1624 - DNA, 13 bp, Artificial Sequence
  synthetic sequence
ctttgtggaaagc

SEQ ID NO: 1625 - DNA, 13 bp, Artificial Sequence
  synthetic sequence
ggtgtgcggtgtt

SEQ ID NO: 1626 - DNA, 13 bp, Artificial Sequence
  synthetic sequence
ttgaaccaggaac

SEQ ID NO: 1627 - DNA, 13 bp, Artificial Sequence
  synthetic sequence
ccttctagattaa

SEQ ID NO: 1628 - DNA, 13 bp, Artificial Sequence
  synthetic sequence
attccctctgctg

SEQ ID NO: 1629 - DNA, 13 bp, Artificial Sequence
  synthetic sequence
aaacagaaagtta

SEQ ID NO: 1630 - DNA, 13 bp, Artificial Sequence
  synthetic sequence
atgtcaattgggt

SEQ ID NO: 1631 - DNA, 13 bp, Artificial Sequence
  synthetic sequence
gagaaagaaaaat

SEQ ID NO: 1632 - DNA, 13 bp, Artificial Sequence
  synthetic sequence
catcttgcgggag

SEQ ID NO: 1633 - DNA, 13 bp, Artificial Sequence
  synthetic sequence
gttaaactttcta

SEQ ID NO: 1634 - DNA, 13 bp, Artificial Sequence
  synthetic sequence
atggaatccatgc

SEQ ID NO: 1635 - DNA, 13 bp, Artificial Sequence
  synthetic sequence
cctttattaaatc

SEQ ID NO: 1636 - DNA, 13 bp, Artificial Sequence
  synthetic sequence
aatttttcctgac

SEQ ID NO: 1637 - DNA, 13 bp, Artificial Sequence
  synthetic sequence
taagtctcgtatc

SEQ ID NO: 1638 - DNA, 13 bp, Artificial Sequence
  synthetic sequence
gtggtactgcctg

SEQ ID NO: 1639 - DNA, 13 bp, Artificial Sequence
  synthetic sequence
ggaaccggtgagt

SEQ ID NO: 1640 - DNA, 13 bp, Artificial Sequence
  synthetic sequence
cctatccccaagg

SEQ ID NO: 1641 - DNA, 13 bp, Artificial Sequence
  synthetic sequence
ccatggcgttagt

SEQ ID NO: 1642 - DNA, 13 bp, Artificial Sequence
  synthetic sequence
gacacactccagt

SEQ ID NO: 1643 - DNA, 13 bp, Artificial Sequence
  synthetic sequence
tcgttatctgtga

SEQ ID NO: 1644 - DNA, 13 bp, Artificial Sequence
  synthetic sequence
tggtcacgaggca

SEQ ID NO: 1645 - DNA, 13 bp, Artificial Sequence
  synthetic sequence
taccaatgttgtg

SEQ ID NO: 1646 - DNA, 13 bp, Artificial Sequence
  synthetic sequence
cgtgctcaaggag

SEQ ID NO: 1647 - DNA, 13 bp, Artificial Sequence
  synthetic sequence
tcaccattgagac

SEQ ID NO: 1648 - DNA, 13 bp, Artificial Sequence
  synthetic sequence
gcaagttccttgc

SEQ ID NO: 1649 - DNA, 13 bp, Artificial Sequence
  synthetic sequence
aacatcgtggacg

SEQ ID NO: 1650 - DNA, 13 bp, Artificial Sequence
  synthetic sequence
cactcccctgtga

SEQ ID NO: 1651 - DNA, 13 bp, Artificial Sequence
  synthetic sequence
ctcagaaaacttg

SEQ ID NO: 1652 - DNA, 13 bp, Artificial Sequence
  synthetic sequence
tttgacatcacca

SEQ ID NO: 1653 - DNA, 13 bp, Artificial Sequence
  synthetic sequence
tgccaggaccatc

SEQ ID NO: 1654 - DNA, 13 bp, Artificial Sequence
  synthetic sequence
tctatcccggcca

SEQ ID NO: 1655 - DNA, 13 bp, Artificial Sequence
  synthetic sequence
aggacctggtcaa

SEQ ID NO: 1656 - DNA, 13 bp, Artificial Sequence
  synthetic sequence
tcgtgtgctgctc

SEQ ID NO: 1657 - DNA, 13 bp, Artificial Sequence
  synthetic sequence
cgatgaggatcgt

SEQ ID NO: 1658 - DNA, 13 bp, Artificial Sequence
  synthetic sequence
ccgtacatcgagc

SEQ ID NO: 1659 - DNA, 13 bp, Artificial Sequence
  synthetic sequence
acggggtgcgcct

SEQ ID NO: 1660 - DNA, 13 bp, Artificial Sequence
  synthetic sequence
ggcaaggctatcc

SEQ ID NO: 1661 - DNA, 13 bp, Artificial Sequence
  synthetic sequence
tgggcaattggtt

SEQ ID NO: 1662 - DNA, 13 bp, Artificial Sequence
  synthetic sequence
gtaagccagctcg

SEQ ID NO: 1663 - DNA, 13 bp, Artificial Sequence
  synthetic sequence
ccctgacgcaccc

SEQ ID NO: 1664 - DNA, 13 bp, Artificial Sequence
  synthetic sequence
ggcactacccctg

SEQ ID NO: 1665 - DNA, 13 bp, Artificial Sequence
  synthetic sequence
agcccactaacca

SEQ ID NO: 1666 - DNA, 13 bp, Artificial Sequence
  synthetic sequence
cggggtgtgtccc

SEQ ID NO: 1667 - DNA, 13 bp, Artificial Sequence
  synthetic sequence
gactcccctgacg

SEQ ID NO: 1668 - DNA, 13 bp, Artificial Sequence
  synthetic sequence
ttcacggacaact

SEQ ID NO: 1669 - DNA, 13 bp, Artificial Sequence
  synthetic sequence
gccgggacaaaaa

SEQ ID NO: 1670 - DNA, 13 bp, Artificial Sequence
  synthetic sequence
tgctccggttcct

SEQ ID NO: 1671 - DNA, 13 bp, Artificial Sequence
  synthetic sequence
gtgggtgcccgga

SEQ ID NO: 1672 - DNA, 13 bp, Artificial Sequence
  synthetic sequence
cggactacaaccc

SEQ ID NO: 1673 - DNA, 13 bp, Artificial Sequence
  synthetic sequence
ggctttggcatta

SEQ ID NO: 1674 - DNA, 13 bp, Artificial Sequence
  synthetic sequence
tgtggcggcgttg

SEQ ID NO: 1675 - DNA, 13 bp, Artificial Sequence
  synthetic sequence
cgcacaacggcct

SEQ ID NO: 1676 - DNA, 13 bp, Artificial Sequence
  synthetic sequence
cgcaagccagctc

SEQ ID NO: 1677 - DNA, 13 bp, Artificial Sequence
  synthetic sequence
gggacaagaacca

SEQ ID NO: 1678 - DNA, 13 bp, Artificial Sequence
  synthetic sequence
ggtgcgtgccctg

SEQ ID NO: 1679 - DNA, 13 bp, Artificial Sequence
  synthetic sequence
gtggacgtgcagt

SEQ ID NO: 1680 - DNA, 13 bp, Artificial Sequence
  synthetic sequence
gaggactgctcca

SEQ ID NO: 1681 - DNA, 13 bp, Artificial Sequence
  synthetic sequence
agcaacacgtggc

SEQ ID NO: 1682 - DNA, 13 bp, Artificial Sequence
  synthetic sequence
tcaccagcccgct

SEQ ID NO: 1683 - DNA, 13 bp, Artificial Sequence
  synthetic sequence
tgcacaggtacgc

SEQ ID NO: 1684 - DNA, 13 bp, Artificial Sequence
  synthetic sequence
aacaacacgcggc

SEQ ID NO: 1685 - DNA, 13 bp, Artificial Sequence
  synthetic sequence
gccaagaccatct

SEQ ID NO: 1686 - DNA, 13 bp, Artificial Sequence
  synthetic sequence
tggggtcccatca

SEQ ID NO: 1687 - DNA, 13 bp, Artificial Sequence
  synthetic sequence
tgcagctcgccga

SEQ ID NO: 1688 - DNA, 13 bp, Artificial Sequence
  synthetic sequence
tgaaggcgacatg

SEQ ID NO: 1689 - DNA, 13 bp, Artificial Sequence
  synthetic sequence
tcacagacaactc

SEQ ID NO: 1690 - DNA, 13 bp, Artificial Sequence
  synthetic sequence
tggtctaccgtga

SEQ ID NO: 1691 - DNA, 13 bp, Artificial Sequence
  synthetic sequence
gattacaaccctc

SEQ ID NO: 1692 - DNA, 13 bp, Artificial Sequence
  synthetic sequence
ggctaggagccgt

SEQ ID NO: 1693 - DNA, 13 bp, Artificial Sequence
  synthetic sequence
aaagccatcccca

SEQ ID NO: 1694 - DNA, 13 bp, Artificial Sequence
  synthetic sequence
cctctgagcccgc

SEQ ID NO: 1695 - DNA, 13 bp, Artificial Sequence
  synthetic sequence
acatcaagggcag

SEQ ID NO: 1696 - DNA, 13 bp, Artificial Sequence
  synthetic sequence
acagcggcacggc

SEQ ID NO: 1697 - DNA, 13 bp, Artificial Sequence
  synthetic sequence
ctcaggaaacttg

SEQ ID NO: 1698 - DNA, 13 bp, Artificial Sequence
  synthetic sequence
tggcagttgagcc

SEQ ID NO: 1699 - DNA, 13 bp, Artificial Sequence
  synthetic sequence
gcaactgttccat

SEQ ID NO: 1700 - DNA, 13 bp, Artificial Sequence
  synthetic sequence
actccacctacgg

SEQ ID NO: 1701 - DNA, 13 bp, Artificial Sequence
  synthetic sequence
tggagttctggga

SEQ ID NO: 1702 - DNA, 13 bp, Artificial Sequence
  synthetic sequence
agcgatcccagcc

SEQ ID NO: 1703 - DNA, 13 bp, Artificial Sequence
  synthetic sequence
ctcaggaagcttg

SEQ ID NO: 1704 - DNA, 13 bp, Artificial Sequence
  synthetic sequence
acgtcaccggggg

SEQ ID NO: 1705 - DNA, 13 bp, Artificial Sequence
  synthetic sequence
ctgccatcctctc

SEQ ID NO: 1706 - DNA, 13 bp, Artificial Sequence
  synthetic sequence
cacactccagtca

SEQ ID NO: 1707 - DNA, 13 bp, Artificial Sequence
  synthetic sequence
tcagcttggaccc

SEQ ID NO: 1708 - DNA, 13 bp, Artificial Sequence
  synthetic sequence
tgcaagcccttgc

SEQ ID NO: 1709 - DNA, 13 bp, Artificial Sequence
  synthetic sequence
taccagtgttgtg

SEQ ID NO: 1710 - DNA, 13 bp, Artificial Sequence
  synthetic sequence
ggccggactataa

SEQ ID NO: 1711 - DNA, 13 bp, Artificial Sequence
  synthetic sequence
gctcgcctcatcg

SEQ ID NO: 1712 - DNA, 13 bp, Artificial Sequence
  synthetic sequence
tgcccgccatcct

SEQ ID NO: 1713 - DNA, 13 bp, Artificial Sequence
  synthetic sequence
aggccatccccct

SEQ ID NO: 1714 - DNA, 13 bp, Artificial Sequence
  synthetic sequence
gaacggtcccagc

SEQ ID NO: 1715 - DNA, 13 bp, Artificial Sequence
  synthetic sequence
cactcccctgtca

SEQ ID NO: 1716 - DNA, 13 bp, Artificial Sequence
  synthetic sequence
taacgggtcaccg

SEQ ID NO: 1717 - DNA, 13 bp, Artificial Sequence
  synthetic sequence
gtggacgtgcaat

SEQ ID NO: 1718 - DNA, 13 bp, Artificial Sequence
  synthetic sequence
tcctaaacctcaa

SEQ ID NO: 1719 - DNA, 13 bp, Artificial Sequence
  synthetic sequence
ggcgtcgccagag

SEQ ID NO: 1720 - DNA, 13 bp, Artificial Sequence
  synthetic sequence
cgtgcttaaggag

SEQ ID NO: 1721 - DNA, 13 bp, Artificial Sequence
  synthetic sequence
gtacattcccgtc

SEQ ID NO: 1722 - DNA, 13 bp, Artificial Sequence
  synthetic sequence
ggcctgactacaa

SEQ ID NO: 1723 - DNA, 13 bp, Artificial Sequence
  synthetic sequence
gcaactgctccat

SEQ ID NO: 1724 - DNA, 13 bp, Artificial Sequence
  synthetic sequence
ccgtccaaaatga

SEQ ID NO: 1725 - DNA, 13 bp, Artificial Sequence
  synthetic sequence
actccacctatgg

SEQ ID NO: 1726 - DNA, 13 bp, Artificial Sequence
  synthetic sequence
aggacatggtcaa

SEQ ID NO: 1727 - DNA, 13 bp, Artificial Sequence
  synthetic sequence
acgctgatgtcat

SEQ ID NO: 1728 - DNA, 13 bp, Artificial Sequence
  synthetic sequence
ttcagccttgacc

SEQ ID NO: 1729 - DNA, 13 bp, Artificial Sequence
  synthetic sequence
tcaactacaccat

SEQ ID NO: 1730 - DNA, 13 bp, Artificial Sequence
  synthetic sequence
ttcgacatcacca

SEQ ID NO: 1731 - DNA, 13 bp, Artificial Sequence
  synthetic sequence
ctttaccatcacc

SEQ ID NO: 1732 - DNA, 13 bp, Artificial Sequence
  synthetic sequence
actccacatatgg

SEQ ID NO: 1733 - DNA, 13 bp, Artificial Sequence
  synthetic sequence
tgttggtgtgcgg

SEQ ID NO: 1734 - DNA, 13 bp, Artificial Sequence
  synthetic sequence
gccaagaccacct

SEQ ID NO: 1735 - DNA, 13 bp, Artificial Sequence
  synthetic sequence
agtggatcaatga

SEQ ID NO: 1736 - DNA, 13 bp, Artificial Sequence
  synthetic sequence
tgtggcattatcc

SEQ ID NO: 1737 - DNA, 13 bp, Artificial Sequence
  synthetic sequence
atgactcagtctt

SEQ ID NO: 1738 - DNA, 13 bp, Artificial Sequence
  synthetic sequence
tggcgctgactct

SEQ ID NO: 1739 - DNA, 13 bp, Artificial Sequence
  synthetic sequence
aagacatggtcaa

SEQ ID NO: 1740 - DNA, 13 bp, Artificial Sequence
  synthetic sequence
gacaaaaatgagg

SEQ ID NO: 1741 - DNA, 13 bp, Artificial Sequence
  synthetic sequence
agagcttccaggt

SEQ ID NO: 1742 - DNA, 13 bp, Artificial Sequence
  synthetic sequence
tggtcacgagaca

SEQ ID NO: 1743 - DNA, 13 bp, Artificial Sequence
  synthetic sequence
cagactacaaccc

SEQ ID NO: 1744 - DNA, 13 bp, Artificial Sequence
  synthetic sequence
ctctcaaggcaac

SEQ ID NO: 1745 - DNA, 13 bp, Artificial Sequence
  synthetic sequence
ggataagctcgga

SEQ ID NO: 1746 - DNA, 13 bp, Artificial Sequence
  synthetic sequence
gtctgcggagacg

SEQ ID NO: 1747 - DNA, 13 bp, Artificial Sequence
  synthetic sequence
tgctgctccatgt

SEQ ID NO: 1748 - DNA, 13 bp, Artificial Sequence
  synthetic sequence
ggcaaggctattc

SEQ ID NO: 1749 - DNA, 13 bp, Artificial Sequence
  synthetic sequence
gctgtgccccaga

SEQ ID NO: 1750 - DNA, 13 bp, Artificial Sequence
  synthetic sequence
ggtttgaggtcac

SEQ ID NO: 1751 - DNA, 13 bp, Artificial Sequence
  synthetic sequence
tcatctcagagag

SEQ ID NO: 1752 - DNA, 13 bp, Artificial Sequence
  synthetic sequence
tcgtgtgttgctc

SEQ ID NO: 1753 - DNA, 13 bp, Artificial Sequence
  synthetic sequence
cgggcgacaatac

SEQ ID NO: 1754 - DNA, 13 bp, Artificial Sequence
  synthetic sequence
ggcacatccccta

SEQ ID NO: 1755 - DNA, 13 bp, Artificial Sequence
  synthetic sequence
acactccaccatg

SEQ ID NO: 1756 - DNA, 13 bp, Artificial Sequence
  synthetic sequence
tgtggcactaccc

SEQ ID NO: 1757 - DNA, 13 bp, Artificial Sequence
  synthetic sequence
tgcgttcgcgagg

SEQ ID NO: 1758 - DNA, 13 bp, Artificial Sequence
  synthetic sequence
atctggccgtggc

SEQ ID NO: 1759 - DNA, 13 bp, Artificial Sequence
  synthetic sequence
acgagggaggccg

SEQ ID NO: 1760 - DNA, 13 bp, Artificial Sequence
  synthetic sequence
tggtccctggggc

SEQ ID NO: 1761 - DNA, 13 bp, Artificial Sequence
  synthetic sequence
attgctccatcta

SEQ ID NO: 1762 - DNA, 13 bp, Artificial Sequence
  synthetic sequence
tgtggcattaccc

SEQ ID NO: 1763 - DNA, 13 bp, Artificial Sequence
  synthetic sequence
cccaagacatgca

SEQ ID NO: 1764 - DNA, 13 bp, Artificial Sequence
  synthetic sequence
tgtggcactatcc

SEQ ID NO: 1765 - DNA, 13 bp, Artificial Sequence
  synthetic sequence
tcacggagaggga

SEQ ID NO: 1766 - DNA, 13 bp, Artificial Sequence
  synthetic sequence
tccggactgagaa

SEQ ID NO: 1767 - DNA, 13 bp, Artificial Sequence
  synthetic sequence
tacatcccgctcg

SEQ ID NO: 1768 - DNA, 13 bp, Artificial Sequence
  synthetic sequence
gcgtgggagacag

SEQ ID NO: 1769 - DNA, 13 bp, Artificial Sequence
  synthetic sequence
aacatcgtggatg

SEQ ID NO: 1770 - DNA, 13 bp, Artificial Sequence
  synthetic sequence
acctgtaccaccc

SEQ ID NO: 1771 - DNA, 13 bp, Artificial Sequence
  synthetic sequence
cttccgagcggtc

SEQ ID NO: 1772 - DNA, 13 bp, Artificial Sequence
  synthetic sequence
gccgatgtcatcc

SEQ ID NO: 1773 - DNA, 13 bp, Artificial Sequence
  synthetic sequence
gttgttccatgtc

SEQ ID NO: 1774 - DNA, 13 bp, Artificial Sequence
  synthetic sequence
tccacttatggca

SEQ ID NO: 1775 - DNA, 13 bp, Artificial Sequence
  synthetic sequence
gcctacgagacct

SEQ ID NO: 1776 - DNA, 13 bp, Artificial Sequence
  synthetic sequence
gcaccaccatcct

SEQ ID NO: 1777 - DNA, 13 bp, Artificial Sequence
  synthetic sequence
ggacgcaagccgg

SEQ ID NO: 1778 - DNA, 13 bp, Artificial Sequence
  synthetic sequence
agtgggtcaatga

SEQ ID NO: 1779 - DNA, 13 bp, Artificial Sequence
  synthetic sequence
ggatcactgaaga

SEQ ID NO: 1780 - DNA, 13 bp, Artificial Sequence
  synthetic sequence
tcgccgtggagcc

SEQ ID NO: 1781 - DNA, 13 bp, Artificial Sequence
  synthetic sequence
tgcctgcgtgtac

SEQ ID NO: 1782 - DNA, 13 bp, Artificial Sequence
  synthetic sequence
gaggtcaccctca

SEQ ID NO: 1783 - DNA, 13 bp, Artificial Sequence
  synthetic sequence
tcagcctggaccc

SEQ ID NO: 1784 - DNA, 13 bp, Artificial Sequence
  synthetic sequence
ctgttcagaatga

SEQ ID NO: 1785 - DNA, 13 bp, Artificial Sequence
  synthetic sequence
agtacctctacgg

SEQ ID NO: 1786 - DNA, 13 bp, Artificial Sequence
  synthetic sequence
tccacccagagct

SEQ ID NO: 1787 - DNA, 13 bp, Artificial Sequence
  synthetic sequence
gtcgtctgctgct

SEQ ID NO: 1788 - DNA, 13 bp, Artificial Sequence
  synthetic sequence
tgcatttgcctgg

SEQ ID NO: 1789 - DNA, 13 bp, Artificial Sequence
  synthetic sequence
ccatagagaccac

SEQ ID NO: 1790 - DNA, 13 bp, Artificial Sequence
  synthetic sequence
agccttcggcccc

SEQ ID NO: 1791 - DNA, 13 bp, Artificial Sequence
  synthetic sequence
aggactgcaattg

SEQ ID NO: 1792 - DNA, 13 bp, Artificial Sequence
  synthetic sequence
cctccaaagccgc

SEQ ID NO: 1793 - DNA, 13 bp, Artificial Sequence
  synthetic sequence
ccatctttactct

SEQ ID NO: 1794 - DNA, 13 bp, Artificial Sequence
  synthetic sequence
tcaccagcctcac

SEQ ID NO: 1795 - DNA, 13 bp, Artificial Sequence
  synthetic sequence
agtcccgttccac

SEQ ID NO: 1796 - DNA, 13 bp, Artificial Sequence
  synthetic sequence
gggggaggcacct

SEQ ID NO: 1797 - DNA, 13 bp, Artificial Sequence
  synthetic sequence
tctcagaccctgc

SEQ ID NO: 1798 - DNA, 13 bp, Artificial Sequence
  synthetic sequence
aagggtaggtggg

SEQ ID NO: 1799 - DNA, 13 bp, Artificial Sequence
  synthetic sequence
cttcaccatcacc

SEQ ID NO: 1800 - DNA, 13 bp, Artificial Sequence
  synthetic sequence
ttgaccttgtcac

SEQ ID NO: 1801 - DNA, 13 bp, Artificial Sequence
  synthetic sequence
tggggccctatca

SEQ ID NO: 1802 - DNA, 13 bp, Artificial Sequence
  synthetic sequence
agtggatcaacga

SEQ ID NO: 1803 - DNA, 13 bp, Artificial Sequence
  synthetic sequence
gcccctcctgacc

SEQ ID NO: 1804 - DNA, 13 bp, Artificial Sequence
  synthetic sequence
acccggacatgga

SEQ ID NO: 1805 - DNA, 13 bp, Artificial Sequence
  synthetic sequence
ctcagaaagcttg

SEQ ID NO: 1806 - DNA, 13 bp, Artificial Sequence
  synthetic sequence
ctagcgacggact

SEQ ID NO: 1807 - DNA, 13 bp, Artificial Sequence
  synthetic sequence
cctggatgcgtcc

SEQ ID NO: 1808 - DNA, 13 bp, Artificial Sequence
  synthetic sequence
ccaggtcccttct

SEQ ID NO: 1809 - DNA, 13 bp, Artificial Sequence
  synthetic sequence
acaccaccggggg

SEQ ID NO: 1810 - DNA, 13 bp, Artificial Sequence
  synthetic sequence
cgcatcgggtggg

SEQ ID NO: 1811 - DNA, 13 bp, Artificial Sequence
  synthetic sequence
gctcgccttatcg

SEQ ID NO: 1812 - DNA, 13 bp, Artificial Sequence
  synthetic sequence
accaagtggaggg

SEQ ID NO: 1813 - DNA, 13 bp, Artificial Sequence
  synthetic sequence
tacatcgaacagg

SEQ ID NO: 1814 - DNA, 13 bp, Artificial Sequence
  synthetic sequence
gccgcgacaaaaa

SEQ ID NO: 1815 - DNA, 13 bp, Artificial Sequence
  synthetic sequence
aaggagattaagg

SEQ ID NO: 1816 - DNA, 13 bp, Artificial Sequence
  synthetic sequence
atgtcttcctgct

SEQ ID NO: 1817 - DNA, 13 bp, Artificial Sequence
  synthetic sequence
gaggagtccatat

SEQ ID NO: 1818 - DNA, 13 bp, Artificial Sequence
  synthetic sequence
gcaccatgctggt

SEQ ID NO: 1819 - DNA, 13 bp, Artificial Sequence
  synthetic sequence
tgtcaagaccatc

SEQ ID NO: 1820 - DNA, 13 bp, Artificial Sequence
  synthetic sequence
aggaacatgtgga

SEQ ID NO: 1821 - DNA, 13 bp, Artificial Sequence
  synthetic sequence
tcactagcccgct

SEQ ID NO: 1822 - DNA, 13 bp, Artificial Sequence
  synthetic sequence
caccagctgtgcc

SEQ ID NO: 1823 - DNA, 13 bp, Artificial Sequence
  synthetic sequence
actacaatccacc

SEQ ID NO: 1824 - DNA, 13 bp, Artificial Sequence
  synthetic sequence
tgtcaagaccacc

SEQ ID NO: 1825 - DNA, 13 bp, Artificial Sequence
  synthetic sequence
aacaccaggccac

SEQ ID NO: 1826 - DNA, 13 bp, Artificial Sequence
  synthetic sequence
gtacatccccgtc

SEQ ID NO: 1827 - DNA, 13 bp, Artificial Sequence
  synthetic sequence
gcttgggaaacag

SEQ ID NO: 1828 - DNA, 13 bp, Artificial Sequence
  synthetic sequence
ggccacgtactct

SEQ ID NO: 1829 - DNA, 13 bp, Artificial Sequence
  synthetic sequence
agacctatcaggt

SEQ ID NO: 1830 - DNA, 13 bp, Artificial Sequence
  synthetic sequence
ggctttggcacta

SEQ ID NO: 1831 - DNA, 13 bp, Artificial Sequence
  synthetic sequence
gtacatccctgtc

SEQ ID NO: 1832 - DNA, 13 bp, Artificial Sequence
  synthetic sequence
tctatcagtgttg

SEQ ID NO: 1833 - DNA, 13 bp, Artificial Sequence
  synthetic sequence
ccatgaggatcgt

SEQ ID NO: 1834 - DNA, 13 bp, Artificial Sequence
  synthetic sequence
cggattacaaccc

SEQ ID NO: 1835 - DNA, 13 bp, Artificial Sequence
  synthetic sequence
tcactagcctcac

SEQ ID NO: 1836 - DNA, 13 bp, Artificial Sequence
  synthetic sequence
tcacgaaatggtt

SEQ ID NO: 1837 - DNA, 13 bp, Artificial Sequence
  synthetic sequence
tgtctcctggcgc

SEQ ID NO: 1838 - DNA, 13 bp, Artificial Sequence
  synthetic sequence
ggctctggcatta

SEQ ID NO: 1839 - DNA, 13 bp, Artificial Sequence
  synthetic sequence
acctgcatgaaca

SEQ ID NO: 1840 - DNA, 13 bp, Artificial Sequence
  synthetic sequence
gtcgttatctgcg

SEQ ID NO: 1841 - DNA, 13 bp, Artificial Sequence
  synthetic sequence
ctgattacaaccc

SEQ ID NO: 1842 - DNA, 13 bp, Artificial Sequence
  synthetic sequence
tcaccagcccact

SEQ ID NO: 1843 - DNA, 13 bp, Artificial Sequence
  synthetic sequence
gccaggaccacct

SEQ ID NO: 1844 - DNA, 13 bp, Artificial Sequence
  synthetic sequence
ctgacaattcaac

SEQ ID NO: 1845 - DNA, 13 bp, Artificial Sequence
  synthetic sequence
aggcaacatgcac

SEQ ID NO: 1846 - DNA, 13 bp, Artificial Sequence
  synthetic sequence
tcaagggagggag

SEQ ID NO: 1847 - DNA, 13 bp, Artificial Sequence
  synthetic sequence
acatcaaaggggg

SEQ ID NO: 1848 - DNA, 13 bp, Artificial Sequence
  synthetic sequence
caggggtggggtc

SEQ ID NO: 1849 - DNA, 13 bp, Artificial Sequence
  synthetic sequence
atgaagtgacact

SEQ ID NO: 1850 - DNA, 13 bp, Artificial Sequence
  synthetic sequence
agacatctcatct

SEQ ID NO: 1851 - DNA, 13 bp, Artificial Sequence
  synthetic sequence
ctgacgagactgc

SEQ ID NO: 1852 - DNA, 13 bp, Artificial Sequence
  synthetic sequence
agcaacacctggc

SEQ ID NO: 1853 - DNA, 13 bp, Artificial Sequence
  synthetic sequence
actccacgtatgg

SEQ ID NO: 1854 - DNA, 13 bp, Artificial Sequence
  synthetic sequence
gagtgctctcagc

SEQ ID NO: 1855 - DNA, 13 bp, Artificial Sequence
  synthetic sequence
ttcagcctagacc

SEQ ID NO: 1856 - DNA, 13 bp, Artificial Sequence
  synthetic sequence
tctgctgctctat

SEQ ID NO: 1857 - DNA, 13 bp, Artificial Sequence
  synthetic sequence
ccggactacaatc

SEQ ID NO: 1858 - DNA, 13 bp, Artificial Sequence
  synthetic sequence
ttcactgacaact

SEQ ID NO: 1859 - DNA, 13 bp, Artificial Sequence
  synthetic sequence
attccacctatgg

SEQ ID NO: 1860 - DNA, 13 bp, Artificial Sequence
  synthetic sequence
agaacattgtgga

SEQ ID NO: 1861 - DNA, 13 bp, Artificial Sequence
  synthetic sequence
gagcggtcccagc

SEQ ID NO: 1862 - DNA, 13 bp, Artificial Sequence
  synthetic sequence
gaacgatcccagc

SEQ ID NO: 1863 - DNA, 13 bp, Artificial Sequence
  synthetic sequence
tgaaggccacttg

SEQ ID NO: 1864 - DNA, 13 bp, Artificial Sequence
  synthetic sequence
tcatctcagaaag

SEQ ID NO: 1865 - DNA, 13 bp, Artificial Sequence
  synthetic sequence
gatgtgttcctgc

SEQ ID NO: 1866 - DNA, 13 bp, Artificial Sequence
  synthetic sequence
gctgttccatgtc

SEQ ID NO: 1867 - DNA, 13 bp, Artificial Sequence
  synthetic sequence
tctgcggagatga

SEQ ID NO: 1868 - DNA, 13 bp, Artificial Sequence
  synthetic sequence
attccacctacgg

SEQ ID NO: 1869 - DNA, 13 bp, Artificial Sequence
  synthetic sequence
cgcaagcccgctc

SEQ ID NO: 1870 - DNA, 13 bp, Artificial Sequence
  synthetic sequence
ccgatgtcattcc

SEQ ID NO: 1871 - DNA, 13 bp, Artificial Sequence
  synthetic sequence
tgaagggtaagtg

SEQ ID NO: 1872 - DNA, 13 bp, Artificial Sequence
  synthetic sequence
cagaatgagatca

SEQ ID NO: 1873 - DNA, 13 bp, Artificial Sequence
  synthetic sequence
cccatatgggcac

SEQ ID NO: 1874 - DNA, 13 bp, Artificial Sequence
  synthetic sequence
actcctggttggg

SEQ ID NO: 1875 - DNA, 13 bp, Artificial Sequence
  synthetic sequence
actccacgtacgg

SEQ ID NO: 1876 - DNA, 13 bp, Artificial Sequence
  synthetic sequence
agcctcactggca

SEQ ID NO: 1877 - DNA, 13 bp, Artificial Sequence
  synthetic sequence
accttgcggtggc

SEQ ID NO: 1878 - DNA, 13 bp, Artificial Sequence
  synthetic sequence
ggctatggcacta

SEQ ID NO: 1879 - DNA, 13 bp, Artificial Sequence
  synthetic sequence
cttctggctgccc

SEQ ID NO: 1880 - DNA, 13 bp, Artificial Sequence
  synthetic sequence
ggtgcgtcccgtg

SEQ ID NO: 1881 - DNA, 13 bp, Artificial Sequence
  synthetic sequence
cgtctccggggga

SEQ ID NO: 1882 - DNA, 13 bp, Artificial Sequence
  synthetic sequence
catgagtggatca

SEQ ID NO: 1883 - DNA, 13 bp, Artificial Sequence
  synthetic sequence
aggcatctcattt

SEQ ID NO: 1884 - DNA, 13 bp, Artificial Sequence
  synthetic sequence
ccatactatcgcc

SEQ ID NO: 1885 - DNA, 13 bp, Artificial Sequence
  synthetic sequence
gctccggcgtgca

SEQ ID NO: 1886 - DNA, 13 bp, Artificial Sequence
  synthetic sequence
ctgtccaaaatga

SEQ ID NO: 1887 - DNA, 13 bp, Artificial Sequence
  synthetic sequence
aggagcgagcgtc

SEQ ID NO: 1888 - DNA, 13 bp, Artificial Sequence
  synthetic sequence
ctgcctgggaaac

SEQ ID NO: 1889 - DNA, 13 bp, Artificial Sequence
  synthetic sequence
ggggcagacacct

SEQ ID NO: 1890 - DNA, 13 bp, Artificial Sequence
  synthetic sequence
aggcatctcatct

SEQ ID NO: 1891 - DNA, 13 bp, Artificial Sequence
  synthetic sequence
gagccagtcgtct

SEQ ID NO: 1892 - DNA, 13 bp, Artificial Sequence
  synthetic sequence
atagagactacca

SEQ ID NO: 1893 - DNA, 13 bp, Artificial Sequence
  synthetic sequence
cccaccttcacca

SEQ ID NO: 1894 - DNA, 13 bp, Artificial Sequence
  synthetic sequence
tgcctgccatcct

SEQ ID NO: 1895 - DNA, 13 bp, Artificial Sequence
  synthetic sequence
accagtcccctga

SEQ ID NO: 1896 - DNA, 13 bp, Artificial Sequence
  synthetic sequence
cctgcaccaccca

SEQ ID NO: 1897 - DNA, 13 bp, Artificial Sequence
  synthetic sequence
tgaacagcacccg

SEQ ID NO: 1898 - DNA, 13 bp, Artificial Sequence
  synthetic sequence
aacatgtggcacg

SEQ ID NO: 1899 - DNA, 13 bp, Artificial Sequence
  synthetic sequence
gtcacggagcgcg

SEQ ID NO: 1900 - DNA, 13 bp, Artificial Sequence
  synthetic sequence
tggggtcctatca

SEQ ID NO: 1901 - DNA, 13 bp, Artificial Sequence
  synthetic sequence
gtgtgtcaggacc

SEQ ID NO: 1902 - DNA, 13 bp, Artificial Sequence
  synthetic sequence
aggaggttaaggc

SEQ ID NO: 1903 - DNA, 13 bp, Artificial Sequence
  synthetic sequence
tgtacccaggcca

SEQ ID NO: 1904 - DNA, 13 bp, Artificial Sequence
  synthetic sequence
aaggagatcaagg

SEQ ID NO: 1905 - DNA, 13 bp, Artificial Sequence
  synthetic sequence
gtcactgaacagg

SEQ ID NO: 1906 - DNA, 13 bp, Artificial Sequence
  synthetic sequence
agcctcaccggca

SEQ ID NO: 1907 - DNA, 13 bp, Artificial Sequence
  synthetic sequence
caaaccctcctct

SEQ ID NO: 1908 - DNA, 13 bp, Artificial Sequence
  synthetic sequence
accaatgctgtga

SEQ ID NO: 1909 - DNA, 13 bp, Artificial Sequence
  synthetic sequence
gggtgcgtaccct

SEQ ID NO: 1910 - DNA, 13 bp, Artificial Sequence
  synthetic sequence
tacgcccctccat

SEQ ID NO: 1911 - DNA, 13 bp, Artificial Sequence
  synthetic sequence
catgctccggctc

SEQ ID NO: 1912 - DNA, 13 bp, Artificial Sequence
  synthetic sequence
gtcgtcatctgtg

SEQ ID NO: 1913 - DNA, 13 bp, Artificial Sequence
  synthetic sequence
cagggttggggcc

SEQ ID NO: 1914 - DNA, 13 bp, Artificial Sequence
  synthetic sequence
gctcgtctcatcg

SEQ ID NO: 1915 - DNA, 13 bp, Artificial Sequence
  synthetic sequence
atgctgatgtcat

SEQ ID NO: 1916 - DNA, 13 bp, Artificial Sequence
  synthetic sequence
cttacatcgagca

SEQ ID NO: 1917 - DNA, 13 bp, Artificial Sequence
  synthetic sequence
ctgaggactgccc

SEQ ID NO: 1918 - DNA, 13 bp, Artificial Sequence
  synthetic sequence
ccactagtcgagc

SEQ ID NO: 1919 - DNA, 13 bp, Artificial Sequence
  synthetic sequence
gccaagatcatct

SEQ ID NO: 1920 - DNA, 13 bp, Artificial Sequence
  synthetic sequence
gggggagacacct

SEQ ID NO: 1921 - DNA, 13 bp, Artificial Sequence
  synthetic sequence
tgcaactgttcta

SEQ ID NO: 1922 - DNA, 13 bp, Artificial Sequence
  synthetic sequence
gttgctccatgtc

SEQ ID NO: 1923 - DNA, 13 bp, Artificial Sequence
  synthetic sequence
agtaacacctggc

SEQ ID NO: 1924 - DNA, 13 bp, Artificial Sequence
  synthetic sequence
gtaccgcagacat

SEQ ID NO: 1925 - DNA, 13 bp, Artificial Sequence
  synthetic sequence
tgggtgccgtgac

SEQ ID NO: 1926 - DNA, 13 bp, Artificial Sequence
  synthetic sequence
ggtccaccgtcag

SEQ ID NO: 1927 - DNA, 13 bp, Artificial Sequence
  synthetic sequence
tggaattttggga

SEQ ID NO: 1928 - DNA, 13 bp, Artificial Sequence
  synthetic sequence
acaacatcctctg

SEQ ID NO: 1929 - DNA, 13 bp, Artificial Sequence
  synthetic sequence
ggcatgcagacgt

SEQ ID NO: 1930 - DNA, 13 bp, Artificial Sequence
  synthetic sequence
gcgtgccctgcgt

SEQ ID NO: 1931 - DNA, 13 bp, Artificial Sequence
  synthetic sequence
cacgagtggatca

SEQ ID NO: 1932 - DNA, 13 bp, Artificial Sequence
  synthetic sequence
gtcaccgggggaa

SEQ ID NO: 1933 - DNA, 13 bp, Artificial Sequence
  synthetic sequence
caaagccgttttt

SEQ ID NO: 1934 - DNA, 13 bp, Artificial Sequence
  synthetic sequence
cggacgtgctgct

SEQ ID NO: 1935 - DNA, 13 bp, Artificial Sequence
  synthetic sequence
tcaccagccttac

SEQ ID NO: 1936 - DNA, 13 bp, Artificial Sequence
  synthetic sequence
aacaaaccctcct

SEQ ID NO: 1937 - DNA, 13 bp, Artificial Sequence
  synthetic sequence
ggtccacagtcag

SEQ ID NO: 1938 - DNA, 13 bp, Artificial Sequence
  synthetic sequence
aaccggagaaggg

SEQ ID NO: 1939 - DNA, 13 bp, Artificial Sequence
  synthetic sequence
gccactgaacctg

SEQ ID NO: 1940 - DNA, 13 bp, Artificial Sequence
  synthetic sequence
aaggccacatgca

SEQ ID NO: 1941 - DNA, 13 bp, Artificial Sequence
  synthetic sequence
agccagcccgcct

SEQ ID NO: 1942 - DNA, 13 bp, Artificial Sequence
  synthetic sequence
gggcggcatatgc

SEQ ID NO: 1943 - DNA, 13 bp, Artificial Sequence
  synthetic sequence
cgctggtgaccta

SEQ ID NO: 1944 - DNA, 13 bp, Artificial Sequence
  synthetic sequence
gtacatacccgtc

SEQ ID NO: 1945 - DNA, 13 bp, Artificial Sequence
  synthetic sequence
cacccaatcacca

SEQ ID NO: 1946 - DNA, 13 bp, Artificial Sequence
  synthetic sequence
tggtgaccggtga

SEQ ID NO: 1947 - DNA, 13 bp, Artificial Sequence
  synthetic sequence
acatctggcacgg

SEQ ID NO: 1948 - DNA, 13 bp, Artificial Sequence
  synthetic sequence
tgtaactgttcca

SEQ ID NO: 1949 - DNA, 13 bp, Artificial Sequence
  synthetic sequence
acatcaaaggccg

SEQ ID NO: 1950 - DNA, 13 bp, Artificial Sequence
  synthetic sequence
tggtcgacggtca

SEQ ID NO: 1951 - DNA, 13 bp, Artificial Sequence
  synthetic sequence
agtcttaaaggac

SEQ ID NO: 1952 - DNA, 13 bp, Artificial Sequence
  synthetic sequence
gcaatgtctggca

SEQ ID NO: 1953 - DNA, 13 bp, Artificial Sequence
  synthetic sequence
cctggatgtgtcc

SEQ ID NO: 1954 - DNA, 13 bp, Artificial Sequence
  synthetic sequence
tcagtttggaccc

SEQ ID NO: 1955 - DNA, 13 bp, Artificial Sequence
  synthetic sequence
ttgactttagcct

SEQ ID NO: 1956 - DNA, 13 bp, Artificial Sequence
  synthetic sequence
cctaccaggtggg

SEQ ID NO: 1957 - DNA, 13 bp, Artificial Sequence
  synthetic sequence
gagcccgtcatct

SEQ ID NO: 1958 - DNA, 13 bp, Artificial Sequence
  synthetic sequence
caccccataacca

SEQ ID NO: 1959 - DNA, 13 bp, Artificial Sequence
  synthetic sequence
tgcacaggtatgc

SEQ ID NO: 1960 - DNA, 13 bp, Artificial Sequence
  synthetic sequence
tggtcgacggtta

SEQ ID NO: 1961 - DNA, 13 bp, Artificial Sequence
  synthetic sequence
acgtccagtacct

SEQ ID NO: 1962 - DNA, 13 bp, Artificial Sequence
  synthetic sequence
actctacctatgg

SEQ ID NO: 1963 - DNA, 13 bp, Artificial Sequence
  synthetic sequence
acaagacccccgc

SEQ ID NO: 1964 - DNA, 13 bp, Artificial Sequence
  synthetic sequence
attacaatccacc

SEQ ID NO: 1965 - DNA, 13 bp, Artificial Sequence
  synthetic sequence
ggataggatgggg

SEQ ID NO: 1966 - DNA, 13 bp, Artificial Sequence
  synthetic sequence
gaacaagctcagg

SEQ ID NO: 1967 - DNA, 13 bp, Artificial Sequence
  synthetic sequence
acatcagggtcga

SEQ ID NO: 1968 - DNA, 13 bp, Artificial Sequence
  synthetic sequence
gcaaacccttgct

SEQ ID NO: 1969 - DNA, 13 bp, Artificial Sequence
  synthetic sequence
ccagcccattaac

SEQ ID NO: 1970 - DNA, 13 bp, Artificial Sequence
  synthetic sequence
gatgtccaatacc

SEQ ID NO: 1971 - DNA, 13 bp, Artificial Sequence
  synthetic sequence
acgtcactggggg

SEQ ID NO: 1972 - DNA, 13 bp, Artificial Sequence
  synthetic sequence
gactgcaactgct

SEQ ID NO: 1973 - DNA, 13 bp, Artificial Sequence
  synthetic sequence
gacatctaccaat

SEQ ID NO: 1974 - DNA, 13 bp, Artificial Sequence
  synthetic sequence
cacagtccagcac

SEQ ID NO: 1975 - DNA, 13 bp, Artificial Sequence
  synthetic sequence
tggagttttggga

SEQ ID NO: 1976 - DNA, 13 bp, Artificial Sequence
  synthetic sequence
gaagaggggcagc

SEQ ID NO: 1977 - DNA, 13 bp, Artificial Sequence
  synthetic sequence
atgactccccaga

SEQ ID NO: 1978 - DNA, 13 bp, Artificial Sequence
  synthetic sequence
ttaccagcccgct

SEQ ID NO: 1979 - DNA, 13 bp, Artificial Sequence
  synthetic sequence
agtggtgagcatg

SEQ ID NO: 1980 - DNA, 13 bp, Artificial Sequence
  synthetic sequence
agtaccaccatcc

SEQ ID NO: 1981 - DNA, 13 bp, Artificial Sequence
  synthetic sequence
aaggagatgaagg

SEQ ID NO: 1982 - DNA, 13 bp, Artificial Sequence
  synthetic sequence
tcaacctgctgcc

SEQ ID NO: 1983 - DNA, 13 bp, Artificial Sequence
  synthetic sequence
ctgaccttgtcac

SEQ ID NO: 1984 - DNA, 13 bp, Artificial Sequence
  synthetic sequence
aaggagatcaagc

SEQ ID NO: 1985 - DNA, 13 bp, Artificial Sequence
  synthetic sequence
ttcatcaaggggg

SEQ ID NO: 1986 - DNA, 13 bp, Artificial Sequence
  synthetic sequence
tcaacttgctccc

SEQ ID NO: 1987 - DNA, 13 bp, Artificial Sequence
  synthetic sequence
ccaccagcagtgc

SEQ ID NO: 1988 - DNA, 13 bp, Artificial Sequence
  synthetic sequence
tcacccgaaacgc

SEQ ID NO: 1989 - DNA, 13 bp, Artificial Sequence
  synthetic sequence
gtgaggacgtcgt

SEQ ID NO: 1990 - DNA, 13 bp, Artificial Sequence
  synthetic sequence
gcttctttacctt

SEQ ID NO: 1991 - DNA, 13 bp, Artificial Sequence
  synthetic sequence
cagggatggggcc

SEQ ID NO: 1992 - DNA, 13 bp, Artificial Sequence
  synthetic sequence
gctgcgtgggaaa

SEQ ID NO: 1993 - DNA, 13 bp, Artificial Sequence
  synthetic sequence
accaaggctgggg

SEQ ID NO: 1994 - DNA, 13 bp, Artificial Sequence
  synthetic sequence
cacactccagtga

SEQ ID NO: 1995 - DNA, 13 bp, Artificial Sequence
  synthetic sequence
tgcaaaatgaggt

SEQ ID NO: 1996 - DNA, 13 bp, Artificial Sequence
  synthetic sequence
actctacttatgg

SEQ ID NO: 1997 - DNA, 13 bp, Artificial Sequence
  synthetic sequence
gcccagggtttgc

SEQ ID NO: 1998 - DNA, 13 bp, Artificial Sequence
  synthetic sequence
tgaccagtcctct

SEQ ID NO: 1999 - DNA, 13 bp, Artificial Sequence
  synthetic sequence
cttaccaggtggg

SEQ ID NO: 2000 - DNA, 13 bp, Artificial Sequence
  synthetic sequence
ttcagtttagacc

SEQ ID NO: 2001 - DNA, 13 bp, Artificial Sequence
  synthetic sequence
tccttaacaacac

SEQ ID NO: 2002 - DNA, 13 bp, Artificial Sequence
  synthetic sequence
cccacgtgacagg

SEQ ID NO: 2003 - DNA, 13 bp, Artificial Sequence
  synthetic sequence
tgttcttgtcggg

SEQ ID NO: 2004 - DNA, 13 bp, Artificial Sequence
  synthetic sequence
agtgctctaagca

SEQ ID NO: 2005 - DNA, 13 bp, Artificial Sequence
  synthetic sequence
acatcaagggtcg

SEQ ID NO: 2006 - DNA, 13 bp, Artificial Sequence
  synthetic sequence
gccagtcattttc

SEQ ID NO: 2007 - DNA, 13 bp, Artificial Sequence
  synthetic sequence
aatacctgtacgg

SEQ ID NO: 2008 - DNA, 13 bp, Artificial Sequence
  synthetic sequence
cccccttgcaagc

SEQ ID NO: 2009 - DNA, 13 bp, Artificial Sequence
  synthetic sequence
aacacttggcacg

SEQ ID NO: 2010 - DNA, 13 bp, Artificial Sequence
  synthetic sequence
acgacttagtcgt

SEQ ID NO: 2011 - DNA, 13 bp, Artificial Sequence
  synthetic sequence
agaacatagtgga

SEQ ID NO: 2012 - DNA, 13 bp, Artificial Sequence
  synthetic sequence
aggacatggtgaa

SEQ ID NO: 2013 - DNA, 13 bp, Artificial Sequence
  synthetic sequence
aaggagataaagg

SEQ ID NO: 2014 - DNA, 13 bp, Artificial Sequence
  synthetic sequence
acagcggcacagc

SEQ ID NO: 2015 - DNA, 13 bp, Artificial Sequence
  synthetic sequence
taccttgtgttca

SEQ ID NO: 2016 - DNA, 13 bp, Artificial Sequence
  synthetic sequence
gcaccactatcct

SEQ ID NO: 2017 - DNA, 13 bp, Artificial Sequence
  synthetic sequence
tgcgtcccttgcg

SEQ ID NO: 2018 - DNA, 13 bp, Artificial Sequence
  synthetic sequence
cggtcagtgagga

SEQ ID NO: 2019 - DNA, 13 bp, Artificial Sequence
  synthetic sequence
aaacctatcaggt

SEQ ID NO: 2020 - DNA, 13 bp, Artificial Sequence
  synthetic sequence
tctggcatggcac

SEQ ID NO: 2021 - DNA, 13 bp, Artificial Sequence
  synthetic sequence
caacagaccctcc

SEQ ID NO: 2022 - DNA, 13 bp, Artificial Sequence
  synthetic sequence
tcagtctggaccc

SEQ ID NO: 2023 - DNA, 13 bp, Artificial Sequence
  synthetic sequence
tcaccatcttcac

SEQ ID NO: 2024 - DNA, 13 bp, Artificial Sequence
  synthetic sequence
aggtggagggtga

SEQ ID NO: 2025 - DNA, 13 bp, Artificial Sequence
  synthetic sequence
aactactgtcttc

SEQ ID NO: 2026 - DNA, 13 bp, Artificial Sequence
  synthetic sequence
ccccaactgagac

SEQ ID NO: 2027 - DNA, 13 bp, Artificial Sequence
  synthetic sequence
tgtgccaggatca

SEQ ID NO: 2028 - DNA, 13 bp, Artificial Sequence
  synthetic sequence
gtgtgccctgtgt

SEQ ID NO: 2029 - DNA, 13 bp, Artificial Sequence
  synthetic sequence
aaggctacttgca

SEQ ID NO: 2030 - DNA, 13 bp, Artificial Sequence
  synthetic sequence
ggctctggcacta

SEQ ID NO: 2031 - DNA, 13 bp, Artificial Sequence
  synthetic sequence
gtacatcccagtc

SEQ ID NO: 2032 - DNA, 13 bp, Artificial Sequence
  synthetic sequence
ttcagcctggatc

SEQ ID NO: 2033 - DNA, 13 bp, Artificial Sequence
  synthetic sequence
gcctacgagatct

SEQ ID NO: 2034 - DNA, 13 bp, Artificial Sequence
  synthetic sequence
atgtccttaagga

SEQ ID NO: 2035 - DNA, 13 bp, Artificial Sequence
  synthetic sequence
gctgacgtcatcc

SEQ ID NO: 2036 - DNA, 13 bp, Artificial Sequence
  synthetic sequence
caggactgtaact

SEQ ID NO: 2037 - DNA, 13 bp, Artificial Sequence
  synthetic sequence
ccttgtgtttgag

SEQ ID NO: 2038 - DNA, 13 bp, Artificial Sequence
  synthetic sequence
acgtgttcctgct

SEQ ID NO: 2039 - DNA, 13 bp, Artificial Sequence
  synthetic sequence
ctgatgtcttcct

SEQ ID NO: 2040 - DNA, 13 bp, Artificial Sequence
  synthetic sequence
ccatgtgagaatg

SEQ ID NO: 2041 - DNA, 13 bp, Artificial Sequence
  synthetic sequence
gtacattccgctc

SEQ ID NO: 2042 - DNA, 13 bp, Artificial Sequence
  synthetic sequence
tgaccacccagca

SEQ ID NO: 2043 - DNA, 13 bp, Artificial Sequence
  synthetic sequence
gaccagggctggg

SEQ ID NO: 2044 - DNA, 13 bp, Artificial Sequence
  synthetic sequence
acctgcttgttac

SEQ ID NO: 2045 - DNA, 13 bp, Artificial Sequence
  synthetic sequence
tggtgagtatgac

SEQ ID NO: 2046 - DNA, 13 bp, Artificial Sequence
  synthetic sequence
aagactgcaattg

SEQ ID NO: 2047 - DNA, 13 bp, Artificial Sequence
  synthetic sequence
ttgagacaaccac

SEQ ID NO: 2048 - DNA, 13 bp, Artificial Sequence
  synthetic sequence
ggccggaagccag

SEQ ID NO: 2049 - DNA, 13 bp, Artificial Sequence
  synthetic sequence
cagaatatcgtgg

SEQ ID NO: 2050 - DNA, 13 bp, Artificial Sequence
  synthetic sequence
aggatgtcgtcaa

SEQ ID NO: 2051 - DNA, 13 bp, Artificial Sequence
  synthetic sequence
acagcgtccagca

SEQ ID NO: 2052 - DNA, 13 bp, Artificial Sequence
  synthetic sequence
ggtcgaaggggag

SEQ ID NO: 2053 - DNA, 13 bp, Artificial Sequence
  synthetic sequence
tgtgtgccctgcg

SEQ ID NO: 2054 - DNA, 13 bp, Artificial Sequence
  synthetic sequence
tggatcactgagg

SEQ ID NO: 2055 - DNA, 13 bp, Artificial Sequence
  synthetic sequence
tcttcacactcac

SEQ ID NO: 2056 - DNA, 13 bp, Artificial Sequence
  synthetic sequence
tcgcccccactcc

SEQ ID NO: 2057 - DNA, 13 bp, Artificial Sequence
  synthetic sequence
gcctacgggacct

SEQ ID NO: 2058 - DNA, 13 bp, Artificial Sequence
  synthetic sequence
gccgcgacaagaa

SEQ ID NO: 2059 - DNA, 13 bp, Artificial Sequence
  synthetic sequence
gctgagggccagc

SEQ ID NO: 2060 - DNA, 13 bp, Artificial Sequence
  synthetic sequence
tccttgaaagcca

SEQ ID NO: 2061 - DNA, 13 bp, Artificial Sequence
  synthetic sequence
aacccatccaata

SEQ ID NO: 2062 - DNA, 13 bp, Artificial Sequence
  synthetic sequence
tgcagaacgaggt

SEQ ID NO: 2063 - DNA, 13 bp, Artificial Sequence
  synthetic sequence
accaaggttgggg

SEQ ID NO: 2064 - DNA, 13 bp, Artificial Sequence
  synthetic sequence
cacatcctgtgac

SEQ ID NO: 2065 - DNA, 13 bp, Artificial Sequence
  synthetic sequence
ctgagcatgacat

SEQ ID NO: 2066 - DNA, 13 bp, Artificial Sequence
  synthetic sequence
catcaagggtagg

SEQ ID NO: 2067 - DNA, 13 bp, Artificial Sequence
  synthetic sequence
actcgaccaggcc

SEQ ID NO: 2068 - DNA, 13 bp, Artificial Sequence
  synthetic sequence
gacctagcggtgg

SEQ ID NO: 2069 - DNA, 13 bp, Artificial Sequence
  synthetic sequence
gcttgcgagatct

SEQ ID NO: 2070 - DNA, 13 bp, Artificial Sequence
  synthetic sequence
gctcgtctgatcg

SEQ ID NO: 2071 - DNA, 13 bp, Artificial Sequence
  synthetic sequence
atgttggtttgcg

SEQ ID NO: 2072 - DNA, 13 bp, Artificial Sequence
  synthetic sequence
gggggtcgcaagc

SEQ ID NO: 2073 - DNA, 13 bp, Artificial Sequence
  synthetic sequence
acatcaaaggcag

SEQ ID NO: 2074 - DNA, 13 bp, Artificial Sequence
  synthetic sequence
tttacactcaccc

SEQ ID NO: 2075 - DNA, 13 bp, Artificial Sequence
  synthetic sequence
cggattataaccc

SEQ ID NO: 2076 - DNA, 13 bp, Artificial Sequence
  synthetic sequence
tttgagatcacca

SEQ ID NO: 2077 - DNA, 13 bp, Artificial Sequence
  synthetic sequence
ggagacgaccttg

SEQ ID NO: 2078 - DNA, 13 bp, Artificial Sequence
  synthetic sequence
ggggtagacacct

SEQ ID NO: 2079 - DNA, 13 bp, Artificial Sequence
  synthetic sequence
ggcaagttcctcg

SEQ ID NO: 2080 - DNA, 13 bp, Artificial Sequence
  synthetic sequence
cggtgcagaatga

SEQ ID NO: 2081 - DNA, 13 bp, Artificial Sequence
  synthetic sequence
cctgatgctgagc

SEQ ID NO: 2082 - DNA, 13 bp, Artificial Sequence
  synthetic sequence
ggccagattacaa

SEQ ID NO: 2083 - DNA, 13 bp, Artificial Sequence
  synthetic sequence
ggccgagacaaga

SEQ ID NO: 2084 - DNA, 13 bp, Artificial Sequence
  synthetic sequence
ctagcggcctgcg

SEQ ID NO: 2085 - DNA, 13 bp, Artificial Sequence
  synthetic sequence
ggaagttcctggc

SEQ ID NO: 2086 - DNA, 13 bp, Artificial Sequence
  synthetic sequence
cgcaaaccagcgc

SEQ ID NO: 2087 - DNA, 13 bp, Artificial Sequence
  synthetic sequence
ccattctatcgcc

SEQ ID NO: 2088 - DNA, 13 bp, Artificial Sequence
  synthetic sequence
tgcgcgacctcgc

SEQ ID NO: 2089 - DNA, 13 bp, Artificial Sequence
  synthetic sequence
tgcgtgccctgtg

SEQ ID NO: 2090 - DNA, 13 bp, Artificial Sequence
  synthetic sequence
catgactcccctg

SEQ ID NO: 2091 - DNA, 13 bp, Artificial Sequence
  synthetic sequence
tcctgcctgctat

SEQ ID NO: 2092 - DNA, 13 bp, Artificial Sequence
  synthetic sequence
ccacaaccctcct

SEQ ID NO: 2093 - DNA, 13 bp, Artificial Sequence
  synthetic sequence
gggaaccttggaa

SEQ ID NO: 2094 - DNA, 13 bp, Artificial Sequence
  synthetic sequence
tgctggtgtgtgg

SEQ ID NO: 2095 - DNA, 13 bp, Artificial Sequence
  synthetic sequence
catgactccccgg

SEQ ID NO: 2096 - DNA, 13 bp, Artificial Sequence
  synthetic sequence
caccccgtgacca

SEQ ID NO: 2097 - DNA, 13 bp, Artificial Sequence
  synthetic sequence
tatagactttggc

SEQ ID NO: 2098 - DNA, 13 bp, Artificial Sequence
  synthetic sequence
cagagcgcgacat

SEQ ID NO: 2099 - DNA, 13 bp, Artificial Sequence
  synthetic sequence
accttcctgggtg

SEQ ID NO: 2100 - DNA, 13 bp, Artificial Sequence
  synthetic sequence
gtccaaatccaca

SEQ ID NO: 2101 - DNA, 13 bp, Artificial Sequence
  synthetic sequence
acacatggcatgg

SEQ ID NO: 2102 - DNA, 13 bp, Artificial Sequence
  synthetic sequence
atccgtcgaaggg

SEQ ID NO: 2103 - DNA, 13 bp, Artificial Sequence
  synthetic sequence
ccatacatcgagc

SEQ ID NO: 2104 - DNA, 13 bp, Artificial Sequence
  synthetic sequence
cattgaggaaggg

SEQ ID NO: 2105 - DNA, 13 bp, Artificial Sequence
  synthetic sequence
tggaattctggga

SEQ ID NO: 2106 - DNA, 13 bp, Artificial Sequence
  synthetic sequence
tcgagacatggaa

SEQ ID NO: 2107 - DNA, 13 bp, Artificial Sequence
  synthetic sequence
caacaccggacga

SEQ ID NO: 2108 - DNA, 13 bp, Artificial Sequence
  synthetic sequence
tggagacttggaa

SEQ ID NO: 2109 - DNA, 13 bp, Artificial Sequence
  synthetic sequence
taaagggcagggt

SEQ ID NO: 2110 - DNA, 13 bp, Artificial Sequence
  synthetic sequence
gcttgggagacag

SEQ ID NO: 2111 - DNA, 13 bp, Artificial Sequence
  synthetic sequence
ttgagccagtcat

SEQ ID NO: 2112 - DNA, 13 bp, Artificial Sequence
  synthetic sequence
ttgccttgtgtga

SEQ ID NO: 2113 - DNA, 13 bp, Artificial Sequence
  synthetic sequence
caccccgtaacca

SEQ ID NO: 2114 - DNA, 13 bp, Artificial Sequence
  synthetic sequence
caccaatggatca

SEQ ID NO: 2115 - DNA, 13 bp, Artificial Sequence
  synthetic sequence
tcaatctactgcc

SEQ ID NO: 2116 - DNA, 13 bp, Artificial Sequence
  synthetic sequence
tacatcgctacgc

SEQ ID NO: 2117 - DNA, 13 bp, Artificial Sequence
  synthetic sequence
ccccctctgtctg

SEQ ID NO: 2118 - DNA, 13 bp, Artificial Sequence
  synthetic sequence
gaggacatggtta

SEQ ID NO: 2119 - DNA, 13 bp, Artificial Sequence
  synthetic sequence
tatggcattaccc

SEQ ID NO: 2120 - DNA, 13 bp, Artificial Sequence
  synthetic sequence
ctaacatcagcgg

SEQ ID NO: 2121 - DNA, 13 bp, Artificial Sequence
  synthetic sequence
agtgacctctacc

SEQ ID NO: 2122 - DNA, 13 bp, Artificial Sequence
  synthetic sequence
acatcaagggtgg

SEQ ID NO: 2123 - DNA, 13 bp, Artificial Sequence
  synthetic sequence
acgccctctacgg

SEQ ID NO: 2124 - DNA, 13 bp, Artificial Sequence
  synthetic sequence
caaggcaactggt

SEQ ID NO: 2125 - DNA, 13 bp, Artificial Sequence
  synthetic sequence
gatctggctgtgg

SEQ ID NO: 2126 - DNA, 13 bp, Artificial Sequence
  synthetic sequence
gggggagacatct

SEQ ID NO: 2127 - DNA, 13 bp, Artificial Sequence
  synthetic sequence
ttaccaggcacgc

SEQ ID NO: 2128 - DNA, 13 bp, Artificial Sequence
  synthetic sequence
tacaccgctacgc

SEQ ID NO: 2129 - DNA, 13 bp, Artificial Sequence
  synthetic sequence
tcatcaagggcgg

SEQ ID NO: 2130 - DNA, 13 bp, Artificial Sequence
  synthetic sequence
cataccaggtggg

SEQ ID NO: 2131 - DNA, 13 bp, Artificial Sequence
  synthetic sequence
ctccagtaaactc

SEQ ID NO: 2132 - DNA, 13 bp, Artificial Sequence
  synthetic sequence
gcttacgagatct

SEQ ID NO: 2133 - DNA, 13 bp, Artificial Sequence
  synthetic sequence
tctgcggggatga

SEQ ID NO: 2134 - DNA, 13 bp, Artificial Sequence
  synthetic sequence
gcccggctcatcg

SEQ ID NO: 2135 - DNA, 13 bp, Artificial Sequence
  synthetic sequence
gtctagaccccac

SEQ ID NO: 2136 - DNA, 13 bp, Artificial Sequence
  synthetic sequence
gggggaagacacc

SEQ ID NO: 2137 - DNA, 13 bp, Artificial Sequence
  synthetic sequence
tgcttgttgcacc

SEQ ID NO: 2138 - DNA, 13 bp, Artificial Sequence
  synthetic sequence
gcttgcgagacct

SEQ ID NO: 2139 - DNA, 13 bp, Artificial Sequence
  synthetic sequence
acataccaagtgg

SEQ ID NO: 2140 - DNA, 13 bp, Artificial Sequence
  synthetic sequence
tcaccagccccct

SEQ ID NO: 2141 - DNA, 13 bp, Artificial Sequence
  synthetic sequence
ttaccatcttcac

SEQ ID NO: 2142 - DNA, 13 bp, Artificial Sequence
  synthetic sequence
tacgccttctacg

SEQ ID NO: 2143 - DNA, 13 bp, Artificial Sequence
  synthetic sequence
gatgggggatgtt

SEQ ID NO: 2144 - DNA, 13 bp, Artificial Sequence
  synthetic sequence
tctgcggggacga

SEQ ID NO: 2145 - DNA, 13 bp, Artificial Sequence
  synthetic sequence
tggggcaagcttg

SEQ ID NO: 2146 - DNA, 13 bp, Artificial Sequence
  synthetic sequence
gactctggcatta

SEQ ID NO: 2147 - DNA, 13 bp, Artificial Sequence
  synthetic sequence
atggcaaattcct

SEQ ID NO: 2148 - DNA, 13 bp, Artificial Sequence
  synthetic sequence
ctattcccaaggc

SEQ ID NO: 2149 - DNA, 13 bp, Artificial Sequence
  synthetic sequence
ggtccactgttag

SEQ ID NO: 2150 - DNA, 13 bp, Artificial Sequence
  synthetic sequence
ctgtccagaatga

SEQ ID NO: 2151 - DNA, 13 bp, Artificial Sequence
  synthetic sequence
gggttctttacct

SEQ ID NO: 2152 - DNA, 13 bp, Artificial Sequence
  synthetic sequence
tacatcgttacgc

SEQ ID NO: 2153 - DNA, 13 bp, Artificial Sequence
  synthetic sequence
ctctcaaagcaac

SEQ ID NO: 2154 - DNA, 13 bp, Artificial Sequence
  synthetic sequence
tgttctcaaggag

SEQ ID NO: 2155 - DNA, 13 bp, Artificial Sequence
  synthetic sequence
ggccccctactgg

SEQ ID NO: 2156 - DNA, 13 bp, Artificial Sequence
  synthetic sequence
tataccaccggtg

SEQ ID NO: 2157 - DNA, 13 bp, Artificial Sequence
  synthetic sequence
cttgaaccagtca

SEQ ID NO: 2158 - DNA, 13 bp, Artificial Sequence
  synthetic sequence
ctgaacatgacat

SEQ ID NO: 2159 - DNA, 13 bp, Artificial Sequence
  synthetic sequence
ggaatgcagatgt

SEQ ID NO: 2160 - DNA, 13 bp, Artificial Sequence
  synthetic sequence
ccatcttgacgct

SEQ ID NO: 2161 - DNA, 13 bp, Artificial Sequence
  synthetic sequence
accttccggggtg

SEQ ID NO: 2162 - DNA, 13 bp, Artificial Sequence
  synthetic sequence
ctacctacggcaa

SEQ ID NO: 2163 - DNA, 13 bp, Artificial Sequence
  synthetic sequence
attggacaacacc

SEQ ID NO: 2164 - DNA, 13 bp, Artificial Sequence
  synthetic sequence
gaccagggttggg

SEQ ID NO: 2165 - DNA, 13 bp, Artificial Sequence
  synthetic sequence
tacatcagtgggt

SEQ ID NO: 2166 - DNA, 13 bp, Artificial Sequence
  synthetic sequence
cgagcgacaatac

SEQ ID NO: 2167 - DNA, 13 bp, Artificial Sequence
  synthetic sequence
acaccactggggg

SEQ ID NO: 2168 - DNA, 13 bp, Artificial Sequence
  synthetic sequence
tatccatcttcac

SEQ ID NO: 2169 - DNA, 13 bp, Artificial Sequence
  synthetic sequence
accagcttgacag

SEQ ID NO: 2170 - DNA, 13 bp, Artificial Sequence
  synthetic sequence
gctcgcctcattg

SEQ ID NO: 2171 - DNA, 13 bp, Artificial Sequence
  synthetic sequence
aagacctgcttga

SEQ ID NO: 2172 - DNA, 13 bp, Artificial Sequence
  synthetic sequence
ggcctgcgggatg

SEQ ID NO: 2173 - DNA, 13 bp, Artificial Sequence
  synthetic sequence
aagcaacatgcac

SEQ ID NO: 2174 - DNA, 13 bp, Artificial Sequence
  synthetic sequence
gcgatttagcggt

SEQ ID NO: 2175 - DNA, 13 bp, Artificial Sequence
  synthetic sequence
tgcagcaacgtct

SEQ ID NO: 2176 - DNA, 13 bp, Artificial Sequence
  synthetic sequence
aatacctggcatg

SEQ ID NO: 2177 - DNA, 13 bp, Artificial Sequence
  synthetic sequence
ccttgactagccc

SEQ ID NO: 2178 - DNA, 13 bp, Artificial Sequence
  synthetic sequence
tacaccagtgggt

SEQ ID NO: 2179 - DNA, 13 bp, Artificial Sequence
  synthetic sequence
aggagattaagct

SEQ ID NO: 2180 - DNA, 13 bp, Artificial Sequence
  synthetic sequence
ccagactataacc

SEQ ID NO: 2181 - DNA, 13 bp, Artificial Sequence
  synthetic sequence
ccgacgtgttctt

SEQ ID NO: 2182 - DNA, 13 bp, Artificial Sequence
  synthetic sequence
gaggacatggtaa

SEQ ID NO: 2183 - DNA, 13 bp, Artificial Sequence
  synthetic sequence
atcctgatgcgga

SEQ ID NO: 2184 - DNA, 13 bp, Artificial Sequence
  synthetic sequence
atggcgtgaggat

SEQ ID NO: 2185 - DNA, 13 bp, Artificial Sequence
  synthetic sequence
ccaatttgggctc

SEQ ID NO: 2186 - DNA, 13 bp, Artificial Sequence
  synthetic sequence
tcagcttggatcc

SEQ ID NO: 2187 - DNA, 13 bp, Artificial Sequence
  synthetic sequence
tgaactccaccag

SEQ ID NO: 2188 - DNA, 13 bp, Artificial Sequence
  synthetic sequence
cagtgccccagag

SEQ ID NO: 2189 - DNA, 13 bp, Artificial Sequence
  synthetic sequence
gtgctaacatgtg

SEQ ID NO: 2190 - DNA, 13 bp, Artificial Sequence
  synthetic sequence
acgtccaatacct

SEQ ID NO: 2191 - DNA, 13 bp, Artificial Sequence
  synthetic sequence
cagactacaatcc

SEQ ID NO: 2192 - DNA, 13 bp, Artificial Sequence
  synthetic sequence
atcctctctcctg

SEQ ID NO: 2193 - DNA, 13 bp, Artificial Sequence
  synthetic sequence
attacaatccgcc

SEQ ID NO: 2194 - DNA, 13 bp, Artificial Sequence
  synthetic sequence
ggaatgccgatgt

SEQ ID NO: 2195 - DNA, 13 bp, Artificial Sequence
  synthetic sequence
catatcaagtggg

SEQ ID NO: 2196 - DNA, 13 bp, Artificial Sequence
  synthetic sequence
gtggacgtacaat

SEQ ID NO: 2197 - DNA, 13 bp, Artificial Sequence
  synthetic sequence
gggggaagacatc

SEQ ID NO: 2198 - DNA, 13 bp, Artificial Sequence
  synthetic sequence
tgctcccagctat

SEQ ID NO: 2199 - DNA, 13 bp, Artificial Sequence
  synthetic sequence
tcaagggtggggc

SEQ ID NO: 2200 - DNA, 13 bp, Artificial Sequence
  synthetic sequence
gcgtgccttgcgt

SEQ ID NO: 2201 - DNA, 13 bp, Artificial Sequence
  synthetic sequence
ataccaccggggg

SEQ ID NO: 2202 - DNA, 13 bp, Artificial Sequence
  synthetic sequence
aaggagataaagc

SEQ ID NO: 2203 - DNA, 13 bp, Artificial Sequence
  synthetic sequence
ggagaatgtcacc

SEQ ID NO: 2204 - DNA, 13 bp, Artificial Sequence
  synthetic sequence
ccacgaccctcct

SEQ ID NO: 2205 - DNA, 13 bp, Artificial Sequence
  synthetic sequence
gaccctaccttca

SEQ ID NO: 2206 - DNA, 13 bp, Artificial Sequence
  synthetic sequence
acatcaccggggg

SEQ ID NO: 2207 - DNA, 13 bp, Artificial Sequence
  synthetic sequence
accgctatgctcc

SEQ ID NO: 2208 - DNA, 13 bp, Artificial Sequence
  synthetic sequence
tgcaaacccctgc

SEQ ID NO: 2209 - DNA, 13 bp, Artificial Sequence
  synthetic sequence
aggattgtaactg

SEQ ID NO: 2210 - DNA, 13 bp, Artificial Sequence
  synthetic sequence
catatcccctacc

SEQ ID NO: 2211 - DNA, 13 bp, Artificial Sequence
  synthetic sequence
caccctgacgctg

SEQ ID NO: 2212 - DNA, 13 bp, Artificial Sequence
  synthetic sequence
ccctacctcgtcg

SEQ ID NO: 2213 - DNA, 13 bp, Artificial Sequence
  synthetic sequence
ggaaggcaatccc

SEQ ID NO: 2214 - DNA, 13 bp, Artificial Sequence
  synthetic sequence
cacctcccttaca

SEQ ID NO: 2215 - DNA, 13 bp, Artificial Sequence
  synthetic sequence
ccgacgtcatccc

SEQ ID NO: 2216 - DNA, 13 bp, Artificial Sequence
  synthetic sequence
tgatcttgcactt

SEQ ID NO: 2217 - DNA, 13 bp, Artificial Sequence
  synthetic sequence
accacaccaactg

SEQ ID NO: 2218 - DNA, 13 bp, Artificial Sequence
  synthetic sequence
tggtctacagtca

SEQ ID NO: 2219 - DNA, 13 bp, Artificial Sequence
  synthetic sequence
agcagaccctcct

SEQ ID NO: 2220 - DNA, 13 bp, Artificial Sequence
  synthetic sequence
ctgacaacagcac

SEQ ID NO: 2221 - DNA, 13 bp, Artificial Sequence
  synthetic sequence
acctaccaagtgg

SEQ ID NO: 2222 - DNA, 13 bp, Artificial Sequence
  synthetic sequence
catccaatcacca

SEQ ID NO: 2223 - DNA, 13 bp, Artificial Sequence
  synthetic sequence
caccaccaccggc

SEQ ID NO: 2224 - DNA, 13 bp, Artificial Sequence
  synthetic sequence
ccggaattgccag

SEQ ID NO: 2225 - DNA, 13 bp, Artificial Sequence
  synthetic sequence
acacacccgatca

SEQ ID NO: 2226 - DNA, 13 bp, Artificial Sequence
  synthetic sequence
atcaaggctgggg

SEQ ID NO: 2227 - DNA, 13 bp, Artificial Sequence
  synthetic sequence
tgcagctggcaga

SEQ ID NO: 2228 - DNA, 13 bp, Artificial Sequence
  synthetic sequence
ccgactacaaccc

SEQ ID NO: 2229 - DNA, 13 bp, Artificial Sequence
  synthetic sequence
cacgtgacggggg

SEQ ID NO: 2230 - DNA, 13 bp, Artificial Sequence
  synthetic sequence
tacacaggtacgc

SEQ ID NO: 2231 - DNA, 13 bp, Artificial Sequence
  synthetic sequence
agaaaggcggccg

SEQ ID NO: 2232 - DNA, 13 bp, Artificial Sequence
  synthetic sequence
tacatcgatatgc

SEQ ID NO: 2233 - DNA, 13 bp, Artificial Sequence
  synthetic sequence
catcctgacgctg

SEQ ID NO: 2234 - DNA, 13 bp, Artificial Sequence
  synthetic sequence
aacatcgtggaca

SEQ ID NO: 2235 - DNA, 13 bp, Artificial Sequence
  synthetic sequence
gagcctatcatct

SEQ ID NO: 2236 - DNA, 13 bp, Artificial Sequence
  synthetic sequence
gcgtcaggctcca

SEQ ID NO: 2237 - DNA, 13 bp, Artificial Sequence
  synthetic sequence
caccaccgtcggc

SEQ ID NO: 2238 - DNA, 13 bp, Artificial Sequence
  synthetic sequence
attcctggttggg

SEQ ID NO: 2239 - DNA, 13 bp, Artificial Sequence
  synthetic sequence
ccagcgacggctt

SEQ ID NO: 2240 - DNA, 13 bp, Artificial Sequence
  synthetic sequence
tgctggtatgcgg

SEQ ID NO: 2241 - DNA, 13 bp, Artificial Sequence
  synthetic sequence
tagagttctggga

SEQ ID NO: 2242 - DNA, 13 bp, Artificial Sequence
  synthetic sequence
attccacatacgg

SEQ ID NO: 2243 - DNA, 13 bp, Artificial Sequence
  synthetic sequence
gcttgcaactggc

SEQ ID NO: 2244 - DNA, 13 bp, Artificial Sequence
  synthetic sequence
aacatgtggcatg

SEQ ID NO: 2245 - DNA, 13 bp, Artificial Sequence
  synthetic sequence
gaggcgcggtttt

SEQ ID NO: 2246 - DNA, 13 bp, Artificial Sequence
  synthetic sequence
cttgagttctggg

SEQ ID NO: 2247 - DNA, 13 bp, Artificial Sequence
  synthetic sequence
agaagggcggccg

SEQ ID NO: 2248 - DNA, 13 bp, Artificial Sequence
  synthetic sequence
tactatcgccggg

SEQ ID NO: 2249 - DNA, 13 bp, Artificial Sequence
  synthetic sequence
tcactgaggctga

SEQ ID NO: 2250 - DNA, 13 bp, Artificial Sequence
  synthetic sequence
gacctagcagtgg

SEQ ID NO: 2251 - DNA, 13 bp, Artificial Sequence
  synthetic sequence
gggtttgatgtca

SEQ ID NO: 2252 - DNA, 13 bp, Artificial Sequence
  synthetic sequence
gagtgcaattgct

SEQ ID NO: 2253 - DNA, 13 bp, Artificial Sequence
  synthetic sequence
agggcgattcccc

SEQ ID NO: 2254 - DNA, 13 bp, Artificial Sequence
  synthetic sequence
tgcacagatacgc

SEQ ID NO: 2255 - DNA, 13 bp, Artificial Sequence
  synthetic sequence
aggcacctcattt

SEQ ID NO: 2256 - DNA, 13 bp, Artificial Sequence
  synthetic sequence
atgttatccctgc

SEQ ID NO: 2257 - DNA, 13 bp, Artificial Sequence
  synthetic sequence
catctgcgagagc

SEQ ID NO: 2258 - DNA, 13 bp, Artificial Sequence
  synthetic sequence
gaccaagggtggg

SEQ ID NO: 2259 - DNA, 13 bp, Artificial Sequence
  synthetic sequence
ccggggtgtgttc

SEQ ID NO: 2260 - DNA, 13 bp, Artificial Sequence
  synthetic sequence
cctccgacgacgg

SEQ ID NO: 2261 - DNA, 13 bp, Artificial Sequence
  synthetic sequence
caggacgttaagc

SEQ ID NO: 2262 - DNA, 13 bp, Artificial Sequence
  synthetic sequence
gatacgtcgaagg

SEQ ID NO: 2263 - DNA, 13 bp, Artificial Sequence
  synthetic sequence
gaggtcggaagcc

SEQ ID NO: 2264 - DNA, 13 bp, Artificial Sequence
  synthetic sequence
tacacgacagggg

SEQ ID NO: 2265 - DNA, 13 bp, Artificial Sequence
  synthetic sequence
tcaccaggcacgc

SEQ ID NO: 2266 - DNA, 13 bp, Artificial Sequence
  synthetic sequence
gccgcgataaaaa

SEQ ID NO: 2267 - DNA, 13 bp, Artificial Sequence
  synthetic sequence
ttgagaagtggaa

SEQ ID NO: 2268 - DNA, 13 bp, Artificial Sequence
  synthetic sequence
tcctgacactgtc

SEQ ID NO: 2269 - DNA, 13 bp, Artificial Sequence
  synthetic sequence
gatcagggctggg

SEQ ID NO: 2270 - DNA, 13 bp, Artificial Sequence
  synthetic sequence
ggatagggtgggg

SEQ ID NO: 2271 - DNA, 13 bp, Artificial Sequence
  synthetic sequence
gcgtggtctgctg

SEQ ID NO: 2272 - DNA, 13 bp, Artificial Sequence
  synthetic sequence
ctgacaattccac

SEQ ID NO: 2273 - DNA, 13 bp, Artificial Sequence
  synthetic sequence
accaaggatgggg

SEQ ID NO: 2274 - DNA, 13 bp, Artificial Sequence
  synthetic sequence
gttgctcaatgtc

SEQ ID NO: 2275 - DNA, 13 bp, Artificial Sequence
  synthetic sequence
agtccatttacca

SEQ ID NO: 2276 - DNA, 13 bp, Artificial Sequence
  synthetic sequence
gggcgcgacaaga

SEQ ID NO: 2277 - DNA, 13 bp, Artificial Sequence
  synthetic sequence
agatgcctacccc

SEQ ID NO: 2278 - DNA, 13 bp, Artificial Sequence
  synthetic sequence
cccatgaggtcgg

SEQ ID NO: 2279 - DNA, 13 bp, Artificial Sequence
  synthetic sequence
atgtctcccccgc

SEQ ID NO: 2280 - DNA, 13 bp, Artificial Sequence
  synthetic sequence
ccgctcatgatct

SEQ ID NO: 2281 - DNA, 13 bp, Artificial Sequence
  synthetic sequence
tgcagtctgtcaa

SEQ ID NO: 2282 - DNA, 13 bp, Artificial Sequence
  synthetic sequence
gacccgtcgctga

SEQ ID NO: 2283 - DNA, 13 bp, Artificial Sequence
  synthetic sequence
ccatctcatcgaa

SEQ ID NO: 2284 - DNA, 13 bp, Artificial Sequence
  synthetic sequence
tggagtgaaaatg

SEQ ID NO: 2285 - DNA, 13 bp, Artificial Sequence
  synthetic sequence
gctcgacaggctg

SEQ ID NO: 2286 - DNA, 13 bp, Artificial Sequence
  synthetic sequence
ttttgacatgtcc

SEQ ID NO: 2287 - DNA, 13 bp, Artificial Sequence
  synthetic sequence
gagtcaaagcagc

SEQ ID NO: 2288 - DNA, 13 bp, Artificial Sequence
  synthetic sequence
cctcctcgatgtt

SEQ ID NO: 2289 - DNA, 13 bp, Artificial Sequence
  synthetic sequence
cgggcgtgagctc

SEQ ID NO: 2290 - DNA, 13 bp, Artificial Sequence
  synthetic sequence
ttgcagtctatca

SEQ ID NO: 2291 - DNA, 13 bp, Artificial Sequence
  synthetic sequence
gccatgatggtag

SEQ ID NO: 2292 - DNA, 13 bp, Artificial Sequence
  synthetic sequence
aggtggatgaggc

SEQ ID NO: 2293 - DNA, 13 bp, Artificial Sequence
  synthetic sequence
gggcaatcattgg

SEQ ID NO: 2294 - DNA, 13 bp, Artificial Sequence
  synthetic sequence
accttcgcccagt

SEQ ID NO: 2295 - DNA, 13 bp, Artificial Sequence
  synthetic sequence
gagaaggtgaaca

SEQ ID NO: 2296 - DNA, 13 bp, Artificial Sequence
  synthetic sequence
ccgtgatgggcgc

SEQ ID NO: 2297 - DNA, 13 bp, Artificial Sequence
  synthetic sequence
cggcagctggcca

SEQ ID NO: 2298 - DNA, 13 bp, Artificial Sequence
  synthetic sequence
aacacgaggaagg

SEQ ID NO: 2299 - DNA, 13 bp, Artificial Sequence
  synthetic sequence
ggggacctcatgg

SEQ ID NO: 2300 - DNA, 13 bp, Artificial Sequence
  synthetic sequence
gggtgaggtagta

SEQ ID NO: 2301 - DNA, 13 bp, Artificial Sequence
  synthetic sequence
gtgaaaaattcgg

SEQ ID NO: 2302 - DNA, 13 bp, Artificial Sequence
  synthetic sequence
gccatgatggtgg

SEQ ID NO: 2303 - DNA, 13 bp, Artificial Sequence
  synthetic sequence
aagccatcaatga

SEQ ID NO: 2304 - DNA, 13 bp, Artificial Sequence
  synthetic sequence
ggtgttggcccat

SEQ ID NO: 2305 - DNA, 13 bp, Artificial Sequence
  synthetic sequence
gtgcagggtgtca

SEQ ID NO: 2306 - DNA, 13 bp, Artificial Sequence
  synthetic sequence
ccggaagttgagg

SEQ ID NO: 2307 - DNA, 13 bp, Artificial Sequence
  synthetic sequence
ctcattctccccc

SEQ ID NO: 2308 - DNA, 13 bp, Artificial Sequence
  synthetic sequence
acagtgaggctgc

SEQ ID NO: 2309 - DNA, 13 bp, Artificial Sequence
  synthetic sequence
gagtcaaaacagc

SEQ ID NO: 2310 - DNA, 13 bp, Artificial Sequence
  synthetic sequence
ccgaggagctggc

SEQ ID NO: 2311 - DNA, 13 bp, Artificial Sequence
  synthetic sequence
ggagtgagatggt

SEQ ID NO: 2312 - DNA, 13 bp, Artificial Sequence
  synthetic sequence
tccgcaggatttc

SEQ ID NO: 2313 - DNA, 13 bp, Artificial Sequence
  synthetic sequence
accttagcccagt

SEQ ID NO: 2314 - DNA, 13 bp, Artificial Sequence
  synthetic sequence
ccatggagtcttt

SEQ ID NO: 2315 - DNA, 13 bp, Artificial Sequence
  synthetic sequence
tggggctgccagt

SEQ ID NO: 2316 - DNA, 13 bp, Artificial Sequence
  synthetic sequence
gggtcacgggtaa

SEQ ID NO: 2317 - DNA, 13 bp, Artificial Sequence
  synthetic sequence
cagtcgttcgtga

SEQ ID NO: 2318 - DNA, 13 bp, Artificial Sequence
  synthetic sequence
gtggtgatggtcc

SEQ ID NO: 2319 - DNA, 13 bp, Artificial Sequence
  synthetic sequence
agggaccggagcc

SEQ ID NO: 2320 - DNA, 13 bp, Artificial Sequence
  synthetic sequence
cggacgttgaggg

SEQ ID NO: 2321 - DNA, 13 bp, Artificial Sequence
  synthetic sequence
gaagagctggcca

SEQ ID NO: 2322 - DNA, 13 bp, Artificial Sequence
  synthetic sequence
ccccagttgtagg

SEQ ID NO: 2323 - DNA, 13 bp, Artificial Sequence
  synthetic sequence
tccgcaggatctc

SEQ ID NO: 2324 - DNA, 13 bp, Artificial Sequence
  synthetic sequence
agtcaaagtcgcc

SEQ ID NO: 2325 - DNA, 13 bp, Artificial Sequence
  synthetic sequence
acctggcatgggc

SEQ ID NO: 2326 - DNA, 13 bp, Artificial Sequence
  synthetic sequence
aggatgatggcat

SEQ ID NO: 2327 - DNA, 13 bp, Artificial Sequence
  synthetic sequence
ggtccatggcgta

SEQ ID NO: 2328 - DNA, 13 bp, Artificial Sequence
  synthetic sequence
aagaacacaagga

SEQ ID NO: 2329 - DNA, 13 bp, Artificial Sequence
  synthetic sequence
agccgtatgagac

SEQ ID NO: 2330 - DNA, 13 bp, Artificial Sequence
  synthetic sequence
tcgccgctcatga

SEQ ID NO: 2331 - DNA, 13 bp, Artificial Sequence
  synthetic sequence
gtgatggtaaggc

SEQ ID NO: 2332 - DNA, 13 bp, Artificial Sequence
  synthetic sequence
agaaggggatctc

SEQ ID NO: 2333 - DNA, 13 bp, Artificial Sequence
  synthetic sequence
gccatcagtgatg

SEQ ID NO: 2334 - DNA, 13 bp, Artificial Sequence
  synthetic sequence
tcttgacatgtcc

SEQ ID NO: 2335 - DNA, 13 bp, Artificial Sequence
  synthetic sequence
agggtggtgaagg

SEQ ID NO: 2336 - DNA, 13 bp, Artificial Sequence
  synthetic sequence
tcaaccaaggccc

SEQ ID NO: 2337 - DNA, 13 bp, Artificial Sequence
  synthetic sequence
ccatctcatcaaa

SEQ ID NO: 2338 - DNA, 13 bp, Artificial Sequence
  synthetic sequence
tttccatagactc

SEQ ID NO: 2339 - DNA, 13 bp, Artificial Sequence
  synthetic sequence
ccgcaggtgcatg

SEQ ID NO: 2340 - DNA, 13 bp, Artificial Sequence
  synthetic sequence
tgagctcatacca

SEQ ID NO: 2341 - DNA, 13 bp, Artificial Sequence
  synthetic sequence
aggagtaggcaaa

SEQ ID NO: 2342 - DNA, 13 bp, Artificial Sequence
  synthetic sequence
cccatgagatcgg

SEQ ID NO: 2343 - DNA, 13 bp, Artificial Sequence
  synthetic sequence
tggtcatagatgt

SEQ ID NO: 2344 - DNA, 13 bp, Artificial Sequence
  synthetic sequence
gctcgacaggccg

SEQ ID NO: 2345 - DNA, 13 bp, Artificial Sequence
  synthetic sequence
tgaccttcttctg

SEQ ID NO: 2346 - DNA, 13 bp, Artificial Sequence
  synthetic sequence
gtccagtggcgcc

SEQ ID NO: 2347 - DNA, 13 bp, Artificial Sequence
  synthetic sequence
gagctgccgaagg

SEQ ID NO: 2348 - DNA, 13 bp, Artificial Sequence
  synthetic sequence
ccatgatggttgt

SEQ ID NO: 2349 - DNA, 13 bp, Artificial Sequence
  synthetic sequence
caggctccccctc

SEQ ID NO: 2350 - DNA, 13 bp, Artificial Sequence
  synthetic sequence
agatggtcataaa

SEQ ID NO: 2351 - DNA, 13 bp, Artificial Sequence
  synthetic sequence
cctgaagagttga

SEQ ID NO: 2352 - DNA, 13 bp, Artificial Sequence
  synthetic sequence
gtctgctgggcgt

SEQ ID NO: 2353 - DNA, 13 bp, Artificial Sequence
  synthetic sequence
atgtcgcccccgc

SEQ ID NO: 2354 - DNA, 13 bp, Artificial Sequence
  synthetic sequence
aggccccgcgtct

SEQ ID NO: 2355 - DNA, 13 bp, Artificial Sequence
  synthetic sequence
gtgaggtagtaat

SEQ ID NO: 2356 - DNA, 13 bp, Artificial Sequence
  synthetic sequence
acctggcacgggc

SEQ ID NO: 2357 - DNA, 13 bp, Artificial Sequence
  synthetic sequence
gagtggtagggtc

SEQ ID NO: 2358 - DNA, 13 bp, Artificial Sequence
  synthetic sequence
cccagtcccgaag

SEQ ID NO: 2359 - DNA, 13 bp, Artificial Sequence
  synthetic sequence
tccatctcgtcaa

SEQ ID NO: 2360 - DNA, 13 bp, Artificial Sequence
  synthetic sequence
tccatttcatcga

SEQ ID NO: 2361 - DNA, 13 bp, Artificial Sequence
  synthetic sequence
ccggtcctgatgt

SEQ ID NO: 2362 - DNA, 13 bp, Artificial Sequence
  synthetic sequence
gacagctggctgg

SEQ ID NO: 2363 - DNA, 13 bp, Artificial Sequence
  synthetic sequence
ggcagtcattggt

SEQ ID NO: 2364 - DNA, 13 bp, Artificial Sequence
  synthetic sequence
cccagctgtaggt

SEQ ID NO: 2365 - DNA, 13 bp, Artificial Sequence
  synthetic sequence
gagtcgaagtcgc

SEQ ID NO: 2366 - DNA, 13 bp, Artificial Sequence
  synthetic sequence
tcgccactcatga

SEQ ID NO: 2367 - DNA, 13 bp, Artificial Sequence
  synthetic sequence
gcccgttggggca

SEQ ID NO: 2368 - DNA, 13 bp, Artificial Sequence
  synthetic sequence
accttggcccagt

SEQ ID NO: 2369 - DNA, 13 bp, Artificial Sequence
  synthetic sequence
acctcctctatgt

SEQ ID NO: 2370 - DNA, 13 bp, Artificial Sequence
  synthetic sequence
acctcagtgaaga

SEQ ID NO: 2371 - DNA, 13 bp, Artificial Sequence
  synthetic sequence
gtgagctcgtacc

SEQ ID NO: 2372 - DNA, 13 bp, Artificial Sequence
  synthetic sequence
aggtcaccttctt

SEQ ID NO: 2373 - DNA, 13 bp, Artificial Sequence
  synthetic sequence
accaggcacctgg

SEQ ID NO: 2374 - DNA, 13 bp, Artificial Sequence
  synthetic sequence
gggttgccgggca

SEQ ID NO: 2375 - DNA, 13 bp, Artificial Sequence
  synthetic sequence
cacctaggtgtca

SEQ ID NO: 2376 - DNA, 13 bp, Artificial Sequence
  synthetic sequence
gctgaggagctgg

SEQ ID NO: 2377 - DNA, 13 bp, Artificial Sequence
  synthetic sequence
tcaggagctgggt

SEQ ID NO: 2378 - DNA, 13 bp, Artificial Sequence
  synthetic sequence
tatgtgtgcagtg

SEQ ID NO: 2379 - DNA, 13 bp, Artificial Sequence
  synthetic sequence
gctgtctctgtta

SEQ ID NO: 2380 - DNA, 13 bp, Artificial Sequence
  synthetic sequence
gagtcaaagtcac

SEQ ID NO: 2381 - DNA, 13 bp, Artificial Sequence
  synthetic sequence
tcgaaatcgcctg

SEQ ID NO: 2382 - DNA, 13 bp, Artificial Sequence
  synthetic sequence
cccccgtcgtagc

SEQ ID NO: 2383 - DNA, 13 bp, Artificial Sequence
  synthetic sequence
ccgcaggtgcacg

SEQ ID NO: 2384 - DNA, 13 bp, Artificial Sequence
  synthetic sequence
cccgaggagttga

SEQ ID NO: 2385 - DNA, 13 bp, Artificial Sequence
  synthetic sequence
tccatctcgtcga

SEQ ID NO: 2386 - DNA, 13 bp, Artificial Sequence
  synthetic sequence
tactctgatggta

SEQ ID NO: 2387 - DNA, 13 bp, Artificial Sequence
  synthetic sequence
gccaggtgatgct

SEQ ID NO: 2388 - DNA, 13 bp, Artificial Sequence
  synthetic sequence
ccagtcctgatgt

SEQ ID NO: 2389 - DNA, 13 bp, Artificial Sequence
  synthetic sequence
agatggtcataga

SEQ ID NO: 2390 - DNA, 13 bp, Artificial Sequence
  synthetic sequence
tgactttggccca

SEQ ID NO: 2391 - DNA, 13 bp, Artificial Sequence
  synthetic sequence
agggtgggtttga

SEQ ID NO: 2392 - DNA, 13 bp, Artificial Sequence
  synthetic sequence
acagggatgaagt

SEQ ID NO: 2393 - DNA, 13 bp, Artificial Sequence
  synthetic sequence
tgggcttgaggcg

SEQ ID NO: 2394 - DNA, 13 bp, Artificial Sequence
  synthetic sequence
gtgactttcttct

SEQ ID NO: 2395 - DNA, 13 bp, Artificial Sequence
  synthetic sequence
tcatttttggcca

SEQ ID NO: 2396 - DNA, 13 bp, Artificial Sequence
  synthetic sequence
accggggaccgca

SEQ ID NO: 2397 - DNA, 13 bp, Artificial Sequence
  synthetic sequence
ttgagtcaaagca

SEQ ID NO: 2398 - DNA, 13 bp, Artificial Sequence
  synthetic sequence
gggataaagtcca

SEQ ID NO: 2399 - DNA, 13 bp, Artificial Sequence
  synthetic sequence
agtaggagtaggc

SEQ ID NO: 2400 - DNA, 13 bp, Artificial Sequence
  synthetic sequence
gagatggccatcc

SEQ ID NO: 2401 - DNA, 13 bp, Artificial Sequence
  synthetic sequence
tccatgttttcca

SEQ ID NO: 2402 - DNA, 13 bp, Artificial Sequence
  synthetic sequence
gagctggagggaa

SEQ ID NO: 2403 - DNA, 13 bp, Artificial Sequence
  synthetic sequence
ggagctgccaaag

SEQ ID NO: 2404 - DNA, 13 bp, Artificial Sequence
  synthetic sequence
aaacacctggtgt

SEQ ID NO: 2405 - DNA, 13 bp, Artificial Sequence
  synthetic sequence
aggtggtcataaa

SEQ ID NO: 2406 - DNA, 13 bp, Artificial Sequence
  synthetic sequence
ggctggaaggtga

SEQ ID NO: 2407 - DNA, 13 bp, Artificial Sequence
  synthetic sequence
tggagatggatca

SEQ ID NO: 2408 - DNA, 13 bp, Artificial Sequence
  synthetic sequence
cagcgggtgtcat

SEQ ID NO: 2409 - DNA, 13 bp, Artificial Sequence
  synthetic sequence
ccacccaagagaa

SEQ ID NO: 2410 - DNA, 13 bp, Artificial Sequence
  synthetic sequence
tgaggtagtagta

SEQ ID NO: 2411 - DNA, 13 bp, Artificial Sequence
  synthetic sequence
cacctaggtgtta

SEQ ID NO: 2412 - DNA, 13 bp, Artificial Sequence
  synthetic sequence
atgatggagtccc

SEQ ID NO: 2413 - DNA, 13 bp, Artificial Sequence
  synthetic sequence
tgctcattgtcca

SEQ ID NO: 2414 - DNA, 13 bp, Artificial Sequence
  synthetic sequence
tctcattttcccc

SEQ ID NO: 2415 - DNA, 13 bp, Artificial Sequence
  synthetic sequence
tgatgttggccgc

SEQ ID NO: 2416 - DNA, 13 bp, Artificial Sequence
  synthetic sequence
acgatgctggagt

SEQ ID NO: 2417 - DNA, 13 bp, Artificial Sequence
  synthetic sequence
cgggtgaggtaat

SEQ ID NO: 2418 - DNA, 13 bp, Artificial Sequence
  synthetic sequence
ccaggcagagtgg

SEQ ID NO: 2419 - DNA, 13 bp, Artificial Sequence
  synthetic sequence
gtatctgagtcac

SEQ ID NO: 2420 - DNA, 13 bp, Artificial Sequence
  synthetic sequence
acagttgtttcag

SEQ ID NO: 2421 - DNA, 13 bp, Artificial Sequence
  synthetic sequence
cattcttagccat

SEQ ID NO: 2422 - DNA, 13 bp, Artificial Sequence
  synthetic sequence
gcggtgatgggag

SEQ ID NO: 2423 - DNA, 13 bp, Artificial Sequence
  synthetic sequence
aacagaacagcca

SEQ ID NO: 2424 - DNA, 13 bp, Artificial Sequence
  synthetic sequence
gccgtgataggcg

SEQ ID NO: 2425 - DNA, 13 bp, Artificial Sequence
  synthetic sequence
tttttgacgtgtc

SEQ ID NO: 2426 - DNA, 13 bp, Artificial Sequence
  synthetic sequence
ccgtggagtcttt

SEQ ID NO: 2427 - DNA, 13 bp, Artificial Sequence
  synthetic sequence
gccatcattgatg

SEQ ID NO: 2428 - DNA, 13 bp, Artificial Sequence
  synthetic sequence
aggtagtagaccc

SEQ ID NO: 2429 - DNA, 13 bp, Artificial Sequence
  synthetic sequence
atcggttggggag

SEQ ID NO: 2430 - DNA, 13 bp, Artificial Sequence
  synthetic sequence
ttggagagggctg

SEQ ID NO: 2431 - DNA, 13 bp, Artificial Sequence
  synthetic sequence
aatctccgagact

SEQ ID NO: 2432 - DNA, 13 bp, Artificial Sequence
  synthetic sequence
cagtcgttggtga

SEQ ID NO: 2433 - DNA, 13 bp, Artificial Sequence
  synthetic sequence
ccatggagtcgtt

SEQ ID NO: 2434 - DNA, 13 bp, Artificial Sequence
  synthetic sequence
ccccaggtgtagg

SEQ ID NO: 2435 - DNA, 13 bp, Artificial Sequence
  synthetic sequence
ccagagctgttga

SEQ ID NO: 2436 - DNA, 13 bp, Artificial Sequence
  synthetic sequence
taagctcgtacca

SEQ ID NO: 2437 - DNA, 13 bp, Artificial Sequence
  synthetic sequence
cacagcacaggaa

SEQ ID NO: 2438 - DNA, 13 bp, Artificial Sequence
  synthetic sequence
ccgcaggtacagg

SEQ ID NO: 2439 - DNA, 13 bp, Artificial Sequence
  synthetic sequence
ccaggcagcacag

SEQ ID NO: 2440 - DNA, 13 bp, Artificial Sequence
  synthetic sequence
ggacatggcccga

SEQ ID NO: 2441 - DNA, 13 bp, Artificial Sequence
  synthetic sequence
ccagttctgatgt

SEQ ID NO: 2442 - DNA, 13 bp, Artificial Sequence
  synthetic sequence
tcaccactcatga

SEQ ID NO: 2443 - DNA, 13 bp, Artificial Sequence
  synthetic sequence
gctctgggcatcc

SEQ ID NO: 2444 - DNA, 13 bp, Artificial Sequence
  synthetic sequence
gggggtaggacca

SEQ ID NO: 2445 - DNA, 13 bp, Artificial Sequence
  synthetic sequence
aggccggtggaca

SEQ ID NO: 2446 - DNA, 13 bp, Artificial Sequence
  synthetic sequence
cgaacgttgaggg

SEQ ID NO: 2447 - DNA, 13 bp, Artificial Sequence
  synthetic sequence
ccacaggtgcatg

SEQ ID NO: 2448 - DNA, 13 bp, Artificial Sequence
  synthetic sequence
cctcctcaatgtt

SEQ ID NO: 2449 - DNA, 13 bp, Artificial Sequence
  synthetic sequence
tggcaggggcact

SEQ ID NO: 2450 - DNA, 13 bp, Artificial Sequence
  synthetic sequence
acatgatcttgaa

SEQ ID NO: 2451 - DNA, 13 bp, Artificial Sequence
  synthetic sequence
tcacactccccct

SEQ ID NO: 2452 - DNA, 13 bp, Artificial Sequence
  synthetic sequence
ggcgtgagccagg

SEQ ID NO: 2453 - DNA, 13 bp, Artificial Sequence
  synthetic sequence
tggagaggatctg

SEQ ID NO: 2454 - DNA, 13 bp, Artificial Sequence
  synthetic sequence
agctggtaattgt

SEQ ID NO: 2455 - DNA, 13 bp, Artificial Sequence
  synthetic sequence
agggctttgatgt

SEQ ID NO: 2456 - DNA, 13 bp, Artificial Sequence
  synthetic sequence
ttgcagtcgatca

SEQ ID NO: 2457 - DNA, 13 bp, Artificial Sequence
  synthetic sequence
agggaactgagta

SEQ ID NO: 2458 - DNA, 13 bp, Artificial Sequence
  synthetic sequence
gtctgctgggcat

SEQ ID NO: 2459 - DNA, 13 bp, Artificial Sequence
  synthetic sequence
tggaggtgcaata

SEQ ID NO: 2460 - DNA, 13 bp, Artificial Sequence
  synthetic sequence
tggaggtggatca

SEQ ID NO: 2461 - DNA, 13 bp, Artificial Sequence
  synthetic sequence
gctgaagagctgg

SEQ ID NO: 2462 - DNA, 13 bp, Artificial Sequence
  synthetic sequence
agatgaagaacca

SEQ ID NO: 2463 - DNA, 13 bp, Artificial Sequence
  synthetic sequence
tcctgaccccggt

SEQ ID NO: 2464 - DNA, 13 bp, Artificial Sequence
  synthetic sequence
acctggcaagggc

SEQ ID NO: 2465 - DNA, 13 bp, Artificial Sequence
  synthetic sequence
tgtcgttcccgcc

SEQ ID NO: 2466 - DNA, 13 bp, Artificial Sequence
  synthetic sequence
tcccgtcacgccc

SEQ ID NO: 2467 - DNA, 13 bp, Artificial Sequence
  synthetic sequence
cccagtcccgcag

SEQ ID NO: 2468 - DNA, 13 bp, Artificial Sequence
  synthetic sequence
gagaaagtgaaca

SEQ ID NO: 2469 - DNA, 13 bp, Artificial Sequence
  synthetic sequence
ccttgatgtaaca

SEQ ID NO: 2470 - DNA, 13 bp, Artificial Sequence
  synthetic sequence
ccatctcccggtc

SEQ ID NO: 2471 - DNA, 13 bp, Artificial Sequence
  synthetic sequence
gcctcatacacaa

SEQ ID NO: 2472 - DNA, 13 bp, Artificial Sequence
  synthetic sequence
cgggtatcatacg

SEQ ID NO: 2473 - DNA, 13 bp, Artificial Sequence
  synthetic sequence
ccacccaggagaa

SEQ ID NO: 2474 - DNA, 13 bp, Artificial Sequence
  synthetic sequence
gccgtatgaggca

SEQ ID NO: 2475 - DNA, 13 bp, Artificial Sequence
  synthetic sequence
cgttgacaggccc

SEQ ID NO: 2476 - DNA, 13 bp, Artificial Sequence
  synthetic sequence
tcaaaagtcacct

SEQ ID NO: 2477 - DNA, 13 bp, Artificial Sequence
  synthetic sequence
cgagtctgctgag

SEQ ID NO: 2478 - DNA, 13 bp, Artificial Sequence
  synthetic sequence
ccccaggtgtaag

SEQ ID NO: 2479 - DNA, 13 bp, Artificial Sequence
  synthetic sequence
ccggttctgatgt

SEQ ID NO: 2480 - DNA, 13 bp, Artificial Sequence
  synthetic sequence
ctccacaaatacc

SEQ ID NO: 2481 - DNA, 13 bp, Artificial Sequence
  synthetic sequence
tcaaccagggccc

SEQ ID NO: 2482 - DNA, 13 bp, Artificial Sequence
  synthetic sequence
cctcctcgatatt

SEQ ID NO: 2483 - DNA, 13 bp, Artificial Sequence
  synthetic sequence
tccgccggaacgg

SEQ ID NO: 2484 - DNA, 13 bp, Artificial Sequence
  synthetic sequence
gcctgctgtggta

SEQ ID NO: 2485 - DNA, 13 bp, Artificial Sequence
  synthetic sequence
ggcaagctcggcc

SEQ ID NO: 2486 - DNA, 13 bp, Artificial Sequence
  synthetic sequence
aaggtgaacagct

SEQ ID NO: 2487 - DNA, 13 bp, Artificial Sequence
  synthetic sequence
acagctggctagc

SEQ ID NO: 2488 - DNA, 13 bp, Artificial Sequence
  synthetic sequence
accttggcccaat

SEQ ID NO: 2489 - DNA, 13 bp, Artificial Sequence
  synthetic sequence
agggatgatagta

SEQ ID NO: 2490 - DNA, 13 bp, Artificial Sequence
  synthetic sequence
aagaactctggag

SEQ ID NO: 2491 - DNA, 13 bp, Artificial Sequence
  synthetic sequence
ccggctctccctc

SEQ ID NO: 2492 - DNA, 13 bp, Artificial Sequence
  synthetic sequence
gagaaggtaaaca

SEQ ID NO: 2493 - DNA, 13 bp, Artificial Sequence
  synthetic sequence
gtggtggggtcac

SEQ ID NO: 2494 - DNA, 13 bp, Artificial Sequence
  synthetic sequence
agtaagctctcag

SEQ ID NO: 2495 - DNA, 13 bp, Artificial Sequence
  synthetic sequence
ggtcggagtgtta

SEQ ID NO: 2496 - DNA, 13 bp, Artificial Sequence
  synthetic sequence
cgaaggtaacctt

SEQ ID NO: 2497 - DNA, 13 bp, Artificial Sequence
  synthetic sequence
ccccgctgtagcc

SEQ ID NO: 2498 - DNA, 13 bp, Artificial Sequence
  synthetic sequence
tcattcttggcca

SEQ ID NO: 2499 - DNA, 13 bp, Artificial Sequence
  synthetic sequence
tccatttcgtcga

SEQ ID NO: 2500 - DNA, 13 bp, Artificial Sequence
  synthetic sequence
tcaaaagttacct

SEQ ID NO: 2501 - DNA, 13 bp, Artificial Sequence
  synthetic sequence
tgggcttgagccg

SEQ ID NO: 2502 - DNA, 13 bp, Artificial Sequence
  synthetic sequence
tctcgggacagcc

SEQ ID NO: 2503 - DNA, 13 bp, Artificial Sequence
  synthetic sequence
actggtatgaact

SEQ ID NO: 2504 - DNA, 13 bp, Artificial Sequence
  synthetic sequence
tctctgcagtcat

SEQ ID NO: 2505 - DNA, 13 bp, Artificial Sequence
  synthetic sequence
ccccagttgtaag

SEQ ID NO: 2506 - DNA, 13 bp, Artificial Sequence
  synthetic sequence
agaaagggatctc

SEQ ID NO: 2507 - DNA, 13 bp, Artificial Sequence
  synthetic sequence
ccggagaccgcat

SEQ ID NO: 2508 - DNA, 13 bp, Artificial Sequence
  synthetic sequence
gtctgctgcgcat

SEQ ID NO: 2509 - DNA, 13 bp, Artificial Sequence
  synthetic sequence
atggagtgttgct

SEQ ID NO: 2510 - DNA, 13 bp, Artificial Sequence
  synthetic sequence
ccatctcatcata

SEQ ID NO: 2511 - DNA, 13 bp, Artificial Sequence
  synthetic sequence
gacatgagggaag

SEQ ID NO: 2512 - DNA, 13 bp, Artificial Sequence
  synthetic sequence
catggagtgaaaa

SEQ ID NO: 2513 - DNA, 13 bp, Artificial Sequence
  synthetic sequence
acataggtgccag

SEQ ID NO: 2514 - DNA, 13 bp, Artificial Sequence
  synthetic sequence
gtaagctcatacc

SEQ ID NO: 2515 - DNA, 13 bp, Artificial Sequence
  synthetic sequence
cccatatgatgcc

SEQ ID NO: 2516 - DNA, 13 bp, Artificial Sequence
  synthetic sequence
tcgacgccggcaa

SEQ ID NO: 2517 - DNA, 13 bp, Artificial Sequence
  synthetic sequence
taccagctcaccg

SEQ ID NO: 2518 - DNA, 13 bp, Artificial Sequence
  synthetic sequence
tgaagttgtggcg

SEQ ID NO: 2519 - DNA, 13 bp, Artificial Sequence
  synthetic sequence
tggttatggtgag

SEQ ID NO: 2520 - DNA, 13 bp, Artificial Sequence
  synthetic sequence
ttcttgaaacact

SEQ ID NO: 2521 - DNA, 13 bp, Artificial Sequence
  synthetic sequence
ccgaaggtctttg

SEQ ID NO: 2522 - DNA, 13 bp, Artificial Sequence
  synthetic sequence
ccggagctgttga

SEQ ID NO: 2523 - DNA, 13 bp, Artificial Sequence
  synthetic sequence
ggcagtgttgaca

SEQ ID NO: 2524 - DNA, 13 bp, Artificial Sequence
  synthetic sequence
ctgggtgtaatcc

SEQ ID NO: 2525 - DNA, 13 bp, Artificial Sequence
  synthetic sequence
gtgttggcccgtg

SEQ ID NO: 2526 - DNA, 13 bp, Artificial Sequence
  synthetic sequence
aaggcttgtccca

SEQ ID NO: 2527 - DNA, 13 bp, Artificial Sequence
  synthetic sequence
tgaggcaacgcca

SEQ ID NO: 2528 - DNA, 13 bp, Artificial Sequence
  synthetic sequence
tacagtcgatcac

SEQ ID NO: 2529 - DNA, 13 bp, Artificial Sequence
  synthetic sequence
gtgagttcgtacc

SEQ ID NO: 2530 - DNA, 13 bp, Artificial Sequence
  synthetic sequence
tcagttcgtacca

SEQ ID NO: 2531 - DNA, 13 bp, Artificial Sequence
  synthetic sequence
cattctctcccca

SEQ ID NO: 2532 - DNA, 13 bp, Artificial Sequence
  synthetic sequence
cacaggtgcacgg

SEQ ID NO: 2533 - DNA, 13 bp, Artificial Sequence
  synthetic sequence
cccgaagagttga

SEQ ID NO: 2534 - DNA, 13 bp, Artificial Sequence
  synthetic sequence
tttgctgggcgta

SEQ ID NO: 2535 - DNA, 13 bp, Artificial Sequence
  synthetic sequence
accccggtcctga

SEQ ID NO: 2536 - DNA, 13 bp, Artificial Sequence
  synthetic sequence
ttacagtctatca

SEQ ID NO: 2537 - DNA, 13 bp, Artificial Sequence
  synthetic sequence
ccccgctgaagcc

SEQ ID NO: 2538 - DNA, 13 bp, Artificial Sequence
  synthetic sequence
cccaggtgtatgt

SEQ ID NO: 2539 - DNA, 13 bp, Artificial Sequence
  synthetic sequence
gatggaggggacc

SEQ ID NO: 2540 - DNA, 13 bp, Artificial Sequence
  synthetic sequence
tcccagtgcggat

SEQ ID NO: 2541 - DNA, 13 bp, Artificial Sequence
  synthetic sequence
tggtgtcatagga

SEQ ID NO: 2542 - DNA, 13 bp, Artificial Sequence
  synthetic sequence
ggacattgccaga

SEQ ID NO: 2543 - DNA, 13 bp, Artificial Sequence
  synthetic sequence
agtggagtggggc

SEQ ID NO: 2544 - DNA, 13 bp, Artificial Sequence
  synthetic sequence
cagccacgttgca

SEQ ID NO: 2545 - DNA, 13 bp, Artificial Sequence
  synthetic sequence
gtcactttcttct

SEQ ID NO: 2546 - DNA, 13 bp, Artificial Sequence
  synthetic sequence
ggggtgagatggt

SEQ ID NO: 2547 - DNA, 13 bp, Artificial Sequence
  synthetic sequence
ggtcaggtagtat

SEQ ID NO: 2548 - DNA, 13 bp, Artificial Sequence
  synthetic sequence
ggttccccctcaa

SEQ ID NO: 2549 - DNA, 13 bp, Artificial Sequence
  synthetic sequence
caaagcagaagaa

SEQ ID NO: 2550 - DNA, 13 bp, Artificial Sequence
  synthetic sequence
tccatctcatcgt

SEQ ID NO: 2551 - DNA, 13 bp, Artificial Sequence
  synthetic sequence
tcagttcatacca

SEQ ID NO: 2552 - DNA, 13 bp, Artificial Sequence
  synthetic sequence
gtagtgatggtcc

SEQ ID NO: 2553 - DNA, 13 bp, Artificial Sequence
  synthetic sequence
ctcatggtggttt

SEQ ID NO: 2554 - DNA, 13 bp, Artificial Sequence
  synthetic sequence
taggcttgaggcg

SEQ ID NO: 2555 - DNA, 13 bp, Artificial Sequence
  synthetic sequence
cctcctctatatt

SEQ ID NO: 2556 - DNA, 13 bp, Artificial Sequence
  synthetic sequence
gtgagccaaggcc

SEQ ID NO: 2557 - DNA, 13 bp, Artificial Sequence
  synthetic sequence
ccgttcttcacgt

SEQ ID NO: 2558 - DNA, 13 bp, Artificial Sequence
  synthetic sequence
gagagctggctcg

SEQ ID NO: 2559 - DNA, 13 bp, Artificial Sequence
  synthetic sequence
caatcgttggtga

SEQ ID NO: 2560 - DNA, 13 bp, Artificial Sequence
  synthetic sequence
tgaagaattcggg

SEQ ID NO: 2561 - DNA, 13 bp, Artificial Sequence
  synthetic sequence
gcagaatttctgc

SEQ ID NO: 2562 - DNA, 13 bp, Artificial Sequence
  synthetic sequence
tcattctttgcca

SEQ ID NO: 2563 - DNA, 13 bp, Artificial Sequence
  synthetic sequence
cagtgatgggagc

SEQ ID NO: 2564 - DNA, 13 bp, Artificial Sequence
  synthetic sequence
cattttcacccca

SEQ ID NO: 2565 - DNA, 13 bp, Artificial Sequence
  synthetic sequence
tcaagcccgtgta

SEQ ID NO: 2566 - DNA, 13 bp, Artificial Sequence
  synthetic sequence
gcagacaactggc

SEQ ID NO: 2567 - DNA, 13 bp, Artificial Sequence
  synthetic sequence
gctttcacatagc

SEQ ID NO: 2568 - DNA, 13 bp, Artificial Sequence
  synthetic sequence
gtggtgatggttc

SEQ ID NO: 2569 - DNA, 13 bp, Artificial Sequence
  synthetic sequence
tcattctcgcccc

SEQ ID NO: 2570 - DNA, 13 bp, Artificial Sequence
  synthetic sequence
ttggggaggaggt

SEQ ID NO: 2571 - DNA, 13 bp, Artificial Sequence
  synthetic sequence
aagccatcaacga

SEQ ID NO: 2572 - DNA, 13 bp, Artificial Sequence
  synthetic sequence
agaccatggagtc

SEQ ID NO: 2573 - DNA, 13 bp, Artificial Sequence
  synthetic sequence
agagctggcttgc

SEQ ID NO: 2574 - DNA, 13 bp, Artificial Sequence
  synthetic sequence
tcttgatgtggcc

SEQ ID NO: 2575 - DNA, 13 bp, Artificial Sequence
  synthetic sequence
ttcttcacatgac

SEQ ID NO: 2576 - DNA, 13 bp, Artificial Sequence
  synthetic sequence
tgagttcatacca

SEQ ID NO: 2577 - DNA, 13 bp, Artificial Sequence
  synthetic sequence
ggtccatgtagtg

SEQ ID NO: 2578 - DNA, 13 bp, Artificial Sequence
  synthetic sequence
tgcatgctctcca

SEQ ID NO: 2579 - DNA, 13 bp, Artificial Sequence
  synthetic sequence
cacggacacttga

SEQ ID NO: 2580 - DNA, 13 bp, Artificial Sequence
  synthetic sequence
tcaccgctcatga

SEQ ID NO: 2581 - DNA, 13 bp, Artificial Sequence
  synthetic sequence
acggggatgaagt

SEQ ID NO: 2582 - DNA, 13 bp, Artificial Sequence
  synthetic sequence
ccatgattgttgt

SEQ ID NO: 2583 - DNA, 13 bp, Artificial Sequence
  synthetic sequence
tcacccgaccaag

SEQ ID NO: 2584 - DNA, 13 bp, Artificial Sequence
  synthetic sequence
caggcatgggcgt

SEQ ID NO: 2585 - DNA, 13 bp, Artificial Sequence
  synthetic sequence
cagtcctaatgtt

SEQ ID NO: 2586 - DNA, 13 bp, Artificial Sequence
  synthetic sequence
aggtggtcataga

SEQ ID NO: 2587 - DNA, 13 bp, Artificial Sequence
  synthetic sequence
cgtgtctgttggg

SEQ ID NO: 2588 - DNA, 13 bp, Artificial Sequence
  synthetic sequence
agtcaaagcaacg

SEQ ID NO: 2589 - DNA, 13 bp, Artificial Sequence
  synthetic sequence
cccgacaagtcga

SEQ ID NO: 2590 - DNA, 13 bp, Artificial Sequence
  synthetic sequence
acgatcggtcgtc

SEQ ID NO: 2591 - DNA, 13 bp, Artificial Sequence
  synthetic sequence
gtctgctgcgcgt

SEQ ID NO: 2592 - DNA, 13 bp, Artificial Sequence
  synthetic sequence
ccaaaggtctttg

SEQ ID NO: 2593 - DNA, 13 bp, Artificial Sequence
  synthetic sequence
gtctgctgagcgt

SEQ ID NO: 2594 - DNA, 13 bp, Artificial Sequence
  synthetic sequence
tccatttcatcaa

SEQ ID NO: 2595 - DNA, 13 bp, Artificial Sequence
  synthetic sequence
gccggcatggtgg

SEQ ID NO: 2596 - DNA, 13 bp, Artificial Sequence
  synthetic sequence
ggattgccgggca

SEQ ID NO: 2597 - DNA, 13 bp, Artificial Sequence
  synthetic sequence
aggcataagcctg

SEQ ID NO: 2598 - DNA, 13 bp, Artificial Sequence
  synthetic sequence
gccatgcgctccg

SEQ ID NO: 2599 - DNA, 13 bp, Artificial Sequence
  synthetic sequence
tcagctcgtacca

SEQ ID NO: 2600 - DNA, 13 bp, Artificial Sequence
  synthetic sequence
acgggcacgaagt

SEQ ID NO: 2601 - DNA, 13 bp, Artificial Sequence
  synthetic sequence
cccaccgtaaacc

SEQ ID NO: 2602 - DNA, 13 bp, Artificial Sequence
  synthetic sequence
ctccacaaacacc

SEQ ID NO: 2603 - DNA, 13 bp, Artificial Sequence
  synthetic sequence
accagacacctgg

SEQ ID NO: 2604 - DNA, 13 bp, Artificial Sequence
  synthetic sequence
cgcaggtgcaggg

SEQ ID NO: 2605 - DNA, 13 bp, Artificial Sequence
  synthetic sequence
cgagcaggcagca

SEQ ID NO: 2606 - DNA, 13 bp, Artificial Sequence
  synthetic sequence
cttcctcgatgtt

SEQ ID NO: 2607 - DNA, 13 bp, Artificial Sequence
  synthetic sequence
tcatttgtgagat

SEQ ID NO: 2608 - DNA, 13 bp, Artificial Sequence
  synthetic sequence
gggttgccaggca

SEQ ID NO: 2609 - DNA, 13 bp, Artificial Sequence
  synthetic sequence
tgatgggcttgca

SEQ ID NO: 2610 - DNA, 13 bp, Artificial Sequence
  synthetic sequence
tcctctatgttgg

SEQ ID NO: 2611 - DNA, 13 bp, Artificial Sequence
  synthetic sequence
gccatcctctcgg

SEQ ID NO: 2612 - DNA, 13 bp, Artificial Sequence
  synthetic sequence
acggggatgaaat

SEQ ID NO: 2613 - DNA, 13 bp, Artificial Sequence
  synthetic sequence
cggtgaagaactc

SEQ ID NO: 2614 - DNA, 13 bp, Artificial Sequence
  synthetic sequence
tccatctcgtcgt

SEQ ID NO: 2615 - DNA, 13 bp, Artificial Sequence
  synthetic sequence
atgacaccgtccc

SEQ ID NO: 2616 - DNA, 13 bp, Artificial Sequence
  synthetic sequence
tgatggcgtcgcg

SEQ ID NO: 2617 - DNA, 13 bp, Artificial Sequence
  synthetic sequence
ttagctcgtacca

SEQ ID NO: 2618 - DNA, 13 bp, Artificial Sequence
  synthetic sequence
gaaaagcccatgg

SEQ ID NO: 2619 - DNA, 13 bp, Artificial Sequence
  synthetic sequence
gttatggtaaggg

SEQ ID NO: 2620 - DNA, 13 bp, Artificial Sequence
  synthetic sequence
aggtggtcatata

SEQ ID NO: 2621 - DNA, 13 bp, Artificial Sequence
  synthetic sequence
gctatgaagaaga

SEQ ID NO: 2622 - DNA, 13 bp, Artificial Sequence
  synthetic sequence
gtatggcagtgac

SEQ ID NO: 2623 - DNA, 13 bp, Artificial Sequence
  synthetic sequence
gcgtccaccccag

SEQ ID NO: 2624 - DNA, 13 bp, Artificial Sequence
  synthetic sequence
gccctctcgggca

SEQ ID NO: 2625 - DNA, 13 bp, Artificial Sequence
  synthetic sequence
gttagttcgtacc

SEQ ID NO: 2626 - DNA, 13 bp, Artificial Sequence
  synthetic sequence
cgagcggggagta

SEQ ID NO: 2627 - DNA, 13 bp, Artificial Sequence
  synthetic sequence
tggtgaggcctgc

SEQ ID NO: 2628 - DNA, 13 bp, Artificial Sequence
  synthetic sequence
accttagcccaat

SEQ ID NO: 2629 - DNA, 13 bp, Artificial Sequence
  synthetic sequence
gctcgccctcaag

SEQ ID NO: 2630 - DNA, 13 bp, Artificial Sequence
  synthetic sequence
tgcagtcgatgac

SEQ ID NO: 2631 - DNA, 13 bp, Artificial Sequence
  synthetic sequence
ggctggccaaagg

SEQ ID NO: 2632 - DNA, 13 bp, Artificial Sequence
  synthetic sequence
gccatccgctctg

SEQ ID NO: 2633 - DNA, 13 bp, Artificial Sequence
  synthetic sequence
gtccagtggcgtc

SEQ ID NO: 2634 - DNA, 13 bp, Artificial Sequence
  synthetic sequence
agagaactcagca

SEQ ID NO: 2635 - DNA, 13 bp, Artificial Sequence
  synthetic sequence
ccttgatgtagca

SEQ ID NO: 2636 - DNA, 13 bp, Artificial Sequence
  synthetic sequence
gatcatagatgta

SEQ ID NO: 2637 - DNA, 13 bp, Artificial Sequence
  synthetic sequence
ccatggagtctct

SEQ ID NO: 2638 - DNA, 13 bp, Artificial Sequence
  synthetic sequence
tgcacctgggtgt

SEQ ID NO: 2639 - DNA, 13 bp, Artificial Sequence
  synthetic sequence
agatggatgaggc

SEQ ID NO: 2640 - DNA, 13 bp, Artificial Sequence
  synthetic sequence
tggaggtggatta

SEQ ID NO: 2641 - DNA, 13 bp, Artificial Sequence
  synthetic sequence
agcagtcattggt

SEQ ID NO: 2642 - DNA, 13 bp, Artificial Sequence
  synthetic sequence
aatggagtgttat

SEQ ID NO: 2643 - DNA, 13 bp, Artificial Sequence
  synthetic sequence
tgactttagccca

SEQ ID NO: 2644 - DNA, 13 bp, Artificial Sequence
  synthetic sequence
acgatgctgctgt

SEQ ID NO: 2645 - DNA, 13 bp, Artificial Sequence
  synthetic sequence
aggtgaacagttg

SEQ ID NO: 2646 - DNA, 13 bp, Artificial Sequence
  synthetic sequence
cagatgaagagga

SEQ ID NO: 2647 - DNA, 13 bp, Artificial Sequence
  synthetic sequence
cgcaagtgcatgg

SEQ ID NO: 2648 - DNA, 13 bp, Artificial Sequence
  synthetic sequence
tggtaatggtcct

SEQ ID NO: 2649 - DNA, 13 bp, Artificial Sequence
  synthetic sequence
tgaagatggatca

SEQ ID NO: 2650 - DNA, 13 bp, Artificial Sequence
  synthetic sequence
gtgggcttgagtc

SEQ ID NO: 2651 - DNA, 13 bp, Artificial Sequence
  synthetic sequence
ccgcaggtgcaag

SEQ ID NO: 2652 - DNA, 13 bp, Artificial Sequence
  synthetic sequence
cttcaagtggagg

SEQ ID NO: 2653 - DNA, 13 bp, Artificial Sequence
  synthetic sequence
gtttcagggtctc

SEQ ID NO: 2654 - DNA, 13 bp, Artificial Sequence
  synthetic sequence
gttgagtcaaaac

SEQ ID NO: 2655 - DNA, 13 bp, Artificial Sequence
  synthetic sequence
taaaaagggatct

SEQ ID NO: 2656 - DNA, 13 bp, Artificial Sequence
  synthetic sequence
agctgccaaaact

SEQ ID NO: 2657 - DNA, 13 bp, Artificial Sequence
  synthetic sequence
ggtttgaggcgga

SEQ ID NO: 2658 - DNA, 13 bp, Artificial Sequence
  synthetic sequence
gctgatagctggc

SEQ ID NO: 2659 - DNA, 13 bp, Artificial Sequence
  synthetic sequence
gttctgacacccg

SEQ ID NO: 2660 - DNA, 13 bp, Artificial Sequence
  synthetic sequence
acgccgcgcaaaa

SEQ ID NO: 2661 - DNA, 13 bp, Artificial Sequence
  synthetic sequence
acgttgagagggg

SEQ ID NO: 2662 - DNA, 13 bp, Artificial Sequence
  synthetic sequence
acctggcatggac

SEQ ID NO: 2663 - DNA, 13 bp, Artificial Sequence
  synthetic sequence
tgagggagctgag

SEQ ID NO: 2664 - DNA, 13 bp, Artificial Sequence
  synthetic sequence
gttagctcatacc

SEQ ID NO: 2665 - DNA, 13 bp, Artificial Sequence
  synthetic sequence
ggtcctgacccac

SEQ ID NO: 2666 - DNA, 13 bp, Artificial Sequence
  synthetic sequence
gtcctgaccccag

SEQ ID NO: 2667 - DNA, 13 bp, Artificial Sequence
  synthetic sequence
tggtgatggtaag

SEQ ID NO: 2668 - DNA, 13 bp, Artificial Sequence
  synthetic sequence
tctccacaggcac

SEQ ID NO: 2669 - DNA, 13 bp, Artificial Sequence
  synthetic sequence
gtgagccagggcc

SEQ ID NO: 2670 - DNA, 13 bp, Artificial Sequence
  synthetic sequence
cattctcacccca

SEQ ID NO: 2671 - DNA, 13 bp, Artificial Sequence
  synthetic sequence
cgatgaccttacc

SEQ ID NO: 2672 - DNA, 13 bp, Artificial Sequence
  synthetic sequence
tggagatggatta

SEQ ID NO: 2673 - DNA, 13 bp, Artificial Sequence
  synthetic sequence
aggtggttgtaga

SEQ ID NO: 2674 - DNA, 13 bp, Artificial Sequence
  synthetic sequence
acagagtcgaagt

SEQ ID NO: 2675 - DNA, 13 bp, Artificial Sequence
  synthetic sequence
gcgtaagccaggg

SEQ ID NO: 2676 - DNA, 13 bp, Artificial Sequence
  synthetic sequence
tagaagggaatct

SEQ ID NO: 2677 - DNA, 13 bp, Artificial Sequence
  synthetic sequence
gtggtgatagtcc

SEQ ID NO: 2678 - DNA, 13 bp, Artificial Sequence
  synthetic sequence
gccttaagatagc

SEQ ID NO: 2679 - DNA, 13 bp, Artificial Sequence
  synthetic sequence
gaggagctagcca

SEQ ID NO: 2680 - DNA, 13 bp, Artificial Sequence
  synthetic sequence
ggcgagacgatga

SEQ ID NO: 2681 - DNA, 13 bp, Artificial Sequence
  synthetic sequence
ttttgatgtggcc

SEQ ID NO: 2682 - DNA, 13 bp, Artificial Sequence
  synthetic sequence
gggttgcctggta

SEQ ID NO: 2683 - DNA, 13 bp, Artificial Sequence
  synthetic sequence
caccctgagctgt

SEQ ID NO: 2684 - DNA, 13 bp, Artificial Sequence
  synthetic sequence
tcatttttagcca

SEQ ID NO: 2685 - DNA, 13 bp, Artificial Sequence
  synthetic sequence
gctcgtggtggta

SEQ ID NO: 2686 - DNA, 13 bp, Artificial Sequence
  synthetic sequence
gcaacgaaccagc

SEQ ID NO: 2687 - DNA, 13 bp, Artificial Sequence
  synthetic sequence
gcctatggcactc

SEQ ID NO: 2688 - DNA, 13 bp, Artificial Sequence
  synthetic sequence
ggtcaccaggctc

SEQ ID NO: 2689 - DNA, 13 bp, Artificial Sequence
  synthetic sequence
atgcaaagcagaa

SEQ ID NO: 2690 - DNA, 13 bp, Artificial Sequence
  synthetic sequence
ctcgttctccccc

SEQ ID NO: 2691 - DNA, 13 bp, Artificial Sequence
  synthetic sequence
ggctaggccatcc

SEQ ID NO: 2692 - DNA, 13 bp, Artificial Sequence
  synthetic sequence
ctgagagctgact

SEQ ID NO: 2693 - DNA, 13 bp, Artificial Sequence
  synthetic sequence
taaaaggggatct

SEQ ID NO: 2694 - DNA, 13 bp, Artificial Sequence
  synthetic sequence
ggcaaggtggaca

SEQ ID NO: 2695 - DNA, 13 bp, Artificial Sequence
  synthetic sequence
tgcagtctatgac

SEQ ID NO: 2696 - DNA, 13 bp, Artificial Sequence
  synthetic sequence
tggggagcaggta

SEQ ID NO: 2697 - DNA, 13 bp, Artificial Sequence
  synthetic sequence
ccgggcagagtgg

SEQ ID NO: 2698 - DNA, 13 bp, Artificial Sequence
  synthetic sequence
acctttgcccagt

SEQ ID NO: 2699 - DNA, 13 bp, Artificial Sequence
  synthetic sequence
taggctttagccg

SEQ ID NO: 2700 - DNA, 13 bp, Artificial Sequence
  synthetic sequence
cagacagctgact

SEQ ID NO: 2701 - DNA, 13 bp, Artificial Sequence
  synthetic sequence
actccgatggtat

SEQ ID NO: 2702 - DNA, 13 bp, Artificial Sequence
  synthetic sequence
aggccggttgaca

SEQ ID NO: 2703 - DNA, 13 bp, Artificial Sequence
  synthetic sequence
atgacagcatcac

SEQ ID NO: 2704 - DNA, 13 bp, Artificial Sequence
  synthetic sequence
taggtaggcgcgc

SEQ ID NO: 2705 - DNA, 13 bp, Artificial Sequence
  synthetic sequence
agagcctgcgaca

SEQ ID NO: 2706 - DNA, 13 bp, Artificial Sequence
  synthetic sequence
gccggtaggtcgg

SEQ ID NO: 2707 - DNA, 13 bp, Artificial Sequence
  synthetic sequence
agcagaggtgttg

SEQ ID NO: 2708 - DNA, 13 bp, Artificial Sequence
  synthetic sequence
cgtagggacgccg

SEQ ID NO: 2709 - DNA, 13 bp, Artificial Sequence
  synthetic sequence
gggaacttcttgg

SEQ ID NO: 2710 - DNA, 13 bp, Artificial Sequence
  synthetic sequence
cagtcgttggtaa

SEQ ID NO: 2711 - DNA, 13 bp, Artificial Sequence
  synthetic sequence
cccaagcggacgt

SEQ ID NO: 2712 - DNA, 13 bp, Artificial Sequence
  synthetic sequence
agggatgtcacag

SEQ ID NO: 2713 - DNA, 13 bp, Artificial Sequence
  synthetic sequence
gaccttggcccac

SEQ ID NO: 2714 - DNA, 13 bp, Artificial Sequence
  synthetic sequence
agaagggtatttc

SEQ ID NO: 2715 - DNA, 13 bp, Artificial Sequence
  synthetic sequence
gcaatcattagtg

SEQ ID NO: 2716 - DNA, 13 bp, Artificial Sequence
  synthetic sequence
tattctcttcctg

SEQ ID NO: 2717 - DNA, 13 bp, Artificial Sequence
  synthetic sequence
ggcagggtggaca

SEQ ID NO: 2718 - DNA, 13 bp, Artificial Sequence
  synthetic sequence
cctgacgagttga

SEQ ID NO: 2719 - DNA, 13 bp, Artificial Sequence
  synthetic sequence
aggtgaacatctg

SEQ ID NO: 2720 - DNA, 13 bp, Artificial Sequence
  synthetic sequence
catgattttgaag

SEQ ID NO: 2721 - DNA, 13 bp, Artificial Sequence
  synthetic sequence
tttttgccatgac

SEQ ID NO: 2722 - DNA, 13 bp, Artificial Sequence
  synthetic sequence
ggccgaaggtctt

SEQ ID NO: 2723 - DNA, 13 bp, Artificial Sequence
  synthetic sequence
gggtcgcgggtca

SEQ ID NO: 2724 - DNA, 13 bp, Artificial Sequence
  synthetic sequence
ctgaggagttgaa

SEQ ID NO: 2725 - DNA, 13 bp, Artificial Sequence
  synthetic sequence
gccttcaggtagc

SEQ ID NO: 2726 - DNA, 13 bp, Artificial Sequence
  synthetic sequence
ggtcgtagatgta

SEQ ID NO: 2727 - DNA, 13 bp, Artificial Sequence
  synthetic sequence
catgggcaggtgg

SEQ ID NO: 2728 - DNA, 13 bp, Artificial Sequence
  synthetic sequence
gttgggtcacacg

SEQ ID NO: 2729 - DNA, 13 bp, Artificial Sequence
  synthetic sequence
aatgacggcgggg

SEQ ID NO: 2730 - DNA, 13 bp, Artificial Sequence
  synthetic sequence
ctaaaggcctgga

SEQ ID NO: 2731 - DNA, 13 bp, Artificial Sequence
  synthetic sequence
cattcttgacgtg

SEQ ID NO: 2732 - DNA, 13 bp, Artificial Sequence
  synthetic sequence
tctctagtcaggt

SEQ ID NO: 2733 - DNA, 13 bp, Artificial Sequence
  synthetic sequence
gcctgtgacactc

SEQ ID NO: 2734 - DNA, 13 bp, Artificial Sequence
  synthetic sequence
gccatgcgctctg

SEQ ID NO: 2735 - DNA, 13 bp, Artificial Sequence
  synthetic sequence
tacagtcgatgac

SEQ ID NO: 2736 - DNA, 13 bp, Artificial Sequence
  synthetic sequence
tcactttcttttg

SEQ ID NO: 2737 - DNA, 13 bp, Artificial Sequence
  synthetic sequence
tgagccaagggcc

SEQ ID NO: 2738 - DNA, 13 bp, Artificial Sequence
  synthetic sequence
acgttgcagtcaa

SEQ ID NO: 2739 - DNA, 13 bp, Artificial Sequence
  synthetic sequence
acctttgcccacg

SEQ ID NO: 2740 - DNA, 13 bp, Artificial Sequence
  synthetic sequence
gccctttcgggca

SEQ ID NO: 2741 - DNA, 13 bp, Artificial Sequence
  synthetic sequence
tcagtgaaaaact

SEQ ID NO: 2742 - DNA, 13 bp, Artificial Sequence
  synthetic sequence
gcagtggagtaag

SEQ ID NO: 2743 - DNA, 13 bp, Artificial Sequence
  synthetic sequence
ctgaaccacactt

SEQ ID NO: 2744 - DNA, 13 bp, Artificial Sequence
  synthetic sequence
tcgaaagtcacct

SEQ ID NO: 2745 - DNA, 13 bp, Artificial Sequence
  synthetic sequence
agaaggggatttc

SEQ ID NO: 2746 - DNA, 13 bp, Artificial Sequence
  synthetic sequence
gcctgtggcactc

SEQ ID NO: 2747 - DNA, 13 bp, Artificial Sequence
  synthetic sequence
tccgcagaatctc

SEQ ID NO: 2748 - DNA, 13 bp, Artificial Sequence
  synthetic sequence
cgggtaaggtgga

SEQ ID NO: 2749 - DNA, 13 bp, Artificial Sequence
  synthetic sequence
catttcgtcaaac

SEQ ID NO: 2750 - DNA, 13 bp, Artificial Sequence
  synthetic sequence
tggcgtaccagaa

SEQ ID NO: 2751 - DNA, 13 bp, Artificial Sequence
  synthetic sequence
gtaggtttgagcc

SEQ ID NO: 2752 - DNA, 13 bp, Artificial Sequence
  synthetic sequence
tatgaaaacccca

SEQ ID NO: 2753 - DNA, 13 bp, Artificial Sequence
  synthetic sequence
ctttgagatagca

SEQ ID NO: 2754 - DNA, 13 bp, Artificial Sequence
  synthetic sequence
tctgctgagcata

SEQ ID NO: 2755 - DNA, 13 bp, Artificial Sequence
  synthetic sequence
ctgtcaaatgtga

SEQ ID NO: 2756 - DNA, 13 bp, Artificial Sequence
  synthetic sequence
actttggcccaat

SEQ ID NO: 2757 - DNA, 13 bp, Artificial Sequence
  synthetic sequence
cccaccaccagcc

SEQ ID NO: 2758 - DNA, 13 bp, Artificial Sequence
  synthetic sequence
ccgcaagtgcagg

SEQ ID NO: 2759 - DNA, 13 bp, Artificial Sequence
  synthetic sequence
cgggatttcccgg

SEQ ID NO: 2760 - DNA, 13 bp, Artificial Sequence
  synthetic sequence
acctcggtgaaaa

SEQ ID NO: 2761 - DNA, 13 bp, Artificial Sequence
  synthetic sequence
tgttgggagtagg

SEQ ID NO: 2762 - DNA, 13 bp, Artificial Sequence
  synthetic sequence
gacaatcattggt

SEQ ID NO: 2763 - DNA, 13 bp, Artificial Sequence
  synthetic sequence
gacaaagcgggca

SEQ ID NO: 2764 - DNA, 13 bp, Artificial Sequence
  synthetic sequence
accacccctaacc

SEQ ID NO: 2765 - DNA, 13 bp, Artificial Sequence
  synthetic sequence
acagtggtctctg

SEQ ID NO: 2766 - DNA, 13 bp, Artificial Sequence
  synthetic sequence
gcggtgatggggg

SEQ ID NO: 2767 - DNA, 13 bp, Artificial Sequence
  synthetic sequence
ccagagctgttaa

SEQ ID NO: 2768 - DNA, 13 bp, Artificial Sequence
  synthetic sequence
tgccccacaagga

SEQ ID NO: 2769 - DNA, 13 bp, Artificial Sequence
  synthetic sequence
ctctcaattatgg

SEQ ID NO: 2770 - DNA, 13 bp, Artificial Sequence
  synthetic sequence
ctaagatggagcc

SEQ ID NO: 2771 - DNA, 13 bp, Artificial Sequence
  synthetic sequence
taagcctgttggg

SEQ ID NO: 2772 - DNA, 13 bp, Artificial Sequence
  synthetic sequence
ccccagttgtacg

SEQ ID NO: 2773 - DNA, 13 bp, Artificial Sequence
  synthetic sequence
agcgagctccgcc

SEQ ID NO: 2774 - DNA, 13 bp, Artificial Sequence
  synthetic sequence
catcacggccccc

SEQ ID NO: 2775 - DNA, 13 bp, Artificial Sequence
  synthetic sequence
gctgagtgatggt

SEQ ID NO: 2776 - DNA, 13 bp, Artificial Sequence
  synthetic sequence
aggtggtcataca

SEQ ID NO: 2777 - DNA, 13 bp, Artificial Sequence
  synthetic sequence
agtaagctggtga

SEQ ID NO: 2778 - DNA, 13 bp, Artificial Sequence
  synthetic sequence
ccgtggagttgaa

SEQ ID NO: 2779 - DNA, 13 bp, Artificial Sequence
  synthetic sequence
acacagatgaaaa

SEQ ID NO: 2780 - DNA, 13 bp, Artificial Sequence
  synthetic sequence
acagctggcttgc

SEQ ID NO: 2781 - DNA, 13 bp, Artificial Sequence
  synthetic sequence
ccttaaggtagca

SEQ ID NO: 2782 - DNA, 13 bp, Artificial Sequence
  synthetic sequence
gagcttggctgct

SEQ ID NO: 2783 - DNA, 13 bp, Artificial Sequence
  synthetic sequence
ggctaggccaccc

SEQ ID NO: 2784 - DNA, 13 bp, Artificial Sequence
  synthetic sequence
agatgaaaaacca

SEQ ID NO: 2785 - DNA, 13 bp, Artificial Sequence
  synthetic sequence
ccttaaaggccac

SEQ ID NO: 2786 - DNA, 13 bp, Artificial Sequence
  synthetic sequence
tggcagcgagtgt

SEQ ID NO: 2787 - DNA, 13 bp, Artificial Sequence
  synthetic sequence
tagaagggtatct

SEQ ID NO: 2788 - DNA, 13 bp, Artificial Sequence
  synthetic sequence
gctggcatagtgg

SEQ ID NO: 2789 - DNA, 13 bp, Artificial Sequence
  synthetic sequence
ggattacctggca

SEQ ID NO: 2790 - DNA, 13 bp, Artificial Sequence
  synthetic sequence
cccgacgagttga

SEQ ID NO: 2791 - DNA, 13 bp, Artificial Sequence
  synthetic sequence
gcaggcgcacggt

SEQ ID NO: 2792 - DNA, 13 bp, Artificial Sequence
  synthetic sequence
gcagcagatgaaa

SEQ ID NO: 2793 - DNA, 13 bp, Artificial Sequence
  synthetic sequence
gcaggatctccgc

SEQ ID NO: 2794 - DNA, 13 bp, Artificial Sequence
  synthetic sequence
tcagctcatacca

SEQ ID NO: 2795 - DNA, 13 bp, Artificial Sequence
  synthetic sequence
gggttccccggca

SEQ ID NO: 2796 - DNA, 13 bp, Artificial Sequence
  synthetic sequence
aggtggtcgtata

SEQ ID NO: 2797 - DNA, 13 bp, Artificial Sequence
  synthetic sequence
tgggagacgagga

SEQ ID NO: 2798 - DNA, 13 bp, Artificial Sequence
  synthetic sequence
tgaccttcttttg

SEQ ID NO: 2799 - DNA, 13 bp, Artificial Sequence
  synthetic sequence
acgttacagtcaa

SEQ ID NO: 2800 - DNA, 13 bp, Artificial Sequence
  synthetic sequence
gaagaactggcca

SEQ ID NO: 2801 - DNA, 13 bp, Artificial Sequence
  synthetic sequence
taggagaacccca

SEQ ID NO: 2802 - DNA, 13 bp, Artificial Sequence
  synthetic sequence
ccgcaagtgcacg

SEQ ID NO: 2803 - DNA, 13 bp, Artificial Sequence
  synthetic sequence
agtgtttagctcc

SEQ ID NO: 2804 - DNA, 13 bp, Artificial Sequence
  synthetic sequence
ggcgtaagccaag

SEQ ID NO: 2805 - DNA, 13 bp, Artificial Sequence
  synthetic sequence
gggaagtcacagt

SEQ ID NO: 2806 - DNA, 13 bp, Artificial Sequence
  synthetic sequence
tttttgacgtggc

SEQ ID NO: 2807 - DNA, 13 bp, Artificial Sequence
  synthetic sequence
gctgtggccttga

SEQ ID NO: 2808 - DNA, 13 bp, Artificial Sequence
  synthetic sequence
tacacccttttgc

SEQ ID NO: 2809 - DNA, 13 bp, Artificial Sequence
  synthetic sequence
gccataatggtgg

SEQ ID NO: 2810 - DNA, 13 bp, Artificial Sequence
  synthetic sequence
gccatgagggaag

SEQ ID NO: 2811 - DNA, 13 bp, Artificial Sequence
  synthetic sequence
agatggtcatata

SEQ ID NO: 2812 - DNA, 13 bp, Artificial Sequence
  synthetic sequence
actgagtcgaagt

SEQ ID NO: 2813 - DNA, 13 bp, Artificial Sequence
  synthetic sequence
gttcgccctcaag

SEQ ID NO: 2814 - DNA, 13 bp, Artificial Sequence
  synthetic sequence
tgggctgcgagca

SEQ ID NO: 2815 - DNA, 13 bp, Artificial Sequence
  synthetic sequence
aaatgtcaccttc

SEQ ID NO: 2816 - DNA, 13 bp, Artificial Sequence
  synthetic sequence
ctcgccgaggaac

SEQ ID NO: 2817 - DNA, 13 bp, Artificial Sequence
  synthetic sequence
gtggtctatggca

SEQ ID NO: 2818 - DNA, 13 bp, Artificial Sequence
  synthetic sequence
aagcctcgagttt

SEQ ID NO: 2819 - DNA, 13 bp, Artificial Sequence
  synthetic sequence
cggccgacgattc

SEQ ID NO: 2820 - DNA, 13 bp, Artificial Sequence
  synthetic sequence
tccatgttctcca

SEQ ID NO: 2821 - DNA, 13 bp, Artificial Sequence
  synthetic sequence
actggtgatctca

SEQ ID NO: 2822 - DNA, 13 bp, Artificial Sequence
  synthetic sequence
gtttgctgggcat

SEQ ID NO: 2823 - DNA, 13 bp, Artificial Sequence
  synthetic sequence
cagtaatgggagc

SEQ ID NO: 2824 - DNA, 13 bp, Artificial Sequence
  synthetic sequence
gcagaatttccgc

SEQ ID NO: 2825 - DNA, 13 bp, Artificial Sequence
  synthetic sequence
cggcgcccactgt

SEQ ID NO: 2826 - DNA, 13 bp, Artificial Sequence
  synthetic sequence
gcaggatttccgc

SEQ ID NO: 2827 - DNA, 13 bp, Artificial Sequence
  synthetic sequence
ccggtgcggatgt

SEQ ID NO: 2828 - DNA, 13 bp, Artificial Sequence
  synthetic sequence
ctggctccccctc

SEQ ID NO: 2829 - DNA, 13 bp, Artificial Sequence
  synthetic sequence
gggcatccggacg

SEQ ID NO: 2830 - DNA, 13 bp, Artificial Sequence
  synthetic sequence
gcagaggagctgg

SEQ ID NO: 2831 - DNA, 13 bp, Artificial Sequence
  synthetic sequence
tgtcatatgagaa

SEQ ID NO: 2832 - DNA, 13 bp, Artificial Sequence
  synthetic sequence
aagcctgcgacac

SEQ ID NO: 2833 - DNA, 13 bp, Artificial Sequence
  synthetic sequence
gagccacaccgag

SEQ ID NO: 2834 - DNA, 13 bp, Artificial Sequence
  synthetic sequence
gtaggcttgagtc

SEQ ID NO: 2835 - DNA, 13 bp, Artificial Sequence
  synthetic sequence
accttcgcccaat

SEQ ID NO: 2836 - DNA, 13 bp, Artificial Sequence
  synthetic sequence
tttttctggcgca

SEQ ID NO: 2837 - DNA, 13 bp, Artificial Sequence
  synthetic sequence
gccgtgatgggag

SEQ ID NO: 2838 - DNA, 13 bp, Artificial Sequence
  synthetic sequence
ccacgcagatgaa

SEQ ID NO: 2839 - DNA, 13 bp, Artificial Sequence
  synthetic sequence
gacaaggctggca

SEQ ID NO: 2840 - DNA, 13 bp, Artificial Sequence
  synthetic sequence
tgatcaagtactc

SEQ ID NO: 2841 - DNA, 13 bp, Artificial Sequence
  synthetic sequence
aatgatggaacat

SEQ ID NO: 2842 - DNA, 13 bp, Artificial Sequence
  synthetic sequence
cattttctcccca

SEQ ID NO: 2843 - DNA, 13 bp, Artificial Sequence
  synthetic sequence
gtgctggccatcc

SEQ ID NO: 2844 - DNA, 13 bp, Artificial Sequence
  synthetic sequence
ctgccacgaacca

SEQ ID NO: 2845 - DNA, 13 bp, Artificial Sequence
  synthetic sequence
aagaactctggtg

SEQ ID NO: 2846 - DNA, 13 bp, Artificial Sequence
  synthetic sequence
gtgaagaattcag

SEQ ID NO: 2847 - DNA, 13 bp, Artificial Sequence
  synthetic sequence
gtggtcacagtcc

SEQ ID NO: 2848 - DNA, 13 bp, Artificial Sequence
  synthetic sequence
gcgtatgctgtga

SEQ ID NO: 2849 - DNA, 13 bp, Artificial Sequence
  synthetic sequence
ttggccatgatag

SEQ ID NO: 2850 - DNA, 13 bp, Artificial Sequence
  synthetic sequence
gggcagtcattag

SEQ ID NO: 2851 - DNA, 13 bp, Artificial Sequence
  synthetic sequence
gtggtctgtggca

SEQ ID NO: 2852 - DNA, 13 bp, Artificial Sequence
  synthetic sequence
cggccgacgatcc

SEQ ID NO: 2853 - DNA, 13 bp, Artificial Sequence
  synthetic sequence
agatggtcataca

SEQ ID NO: 2854 - DNA, 13 bp, Artificial Sequence
  synthetic sequence
actttagcccagt

SEQ ID NO: 2855 - DNA, 13 bp, Artificial Sequence
  synthetic sequence
tcttcacatggcc

SEQ ID NO: 2856 - DNA, 13 bp, Artificial Sequence
  synthetic sequence
aggaggggagtgg

SEQ ID NO: 2857 - DNA, 13 bp, Artificial Sequence
  synthetic sequence
ggattgccaggca

SEQ ID NO: 2858 - DNA, 13 bp, Artificial Sequence
  synthetic sequence
ggccaaaggactt

SEQ ID NO: 2859 - DNA, 13 bp, Artificial Sequence
  synthetic sequence
gtgtcaatgagcg

SEQ ID NO: 2860 - DNA, 13 bp, Artificial Sequence
  synthetic sequence
gaagagctggcct

SEQ ID NO: 2861 - DNA, 13 bp, Artificial Sequence
  synthetic sequence
gcacgcacaccca

SEQ ID NO: 2862 - DNA, 13 bp, Artificial Sequence
  synthetic sequence
acttttagccagt

SEQ ID NO: 2863 - DNA, 13 bp, Artificial Sequence
  synthetic sequence
ctttcacgtagca

SEQ ID NO: 2864 - DNA, 13 bp, Artificial Sequence
  synthetic sequence
catcacggccacc

SEQ ID NO: 2865 - DNA, 13 bp, Artificial Sequence
  synthetic sequence
agctttgcagctc

SEQ ID NO: 2866 - DNA, 13 bp, Artificial Sequence
  synthetic sequence
gccgcttgagctt

SEQ ID NO: 2867 - DNA, 13 bp, Artificial Sequence
  synthetic sequence
tggaggtgtatga

SEQ ID NO: 2868 - DNA, 13 bp, Artificial Sequence
  synthetic sequence
tcatttgtgatgt

SEQ ID NO: 2869 - DNA, 13 bp, Artificial Sequence
  synthetic sequence
ggccaaagctctt

SEQ ID NO: 2870 - DNA, 13 bp, Artificial Sequence
  synthetic sequence
gtctgctgagtgt

SEQ ID NO: 2871 - DNA, 13 bp, Artificial Sequence
  synthetic sequence
cccgtccaagcgt

SEQ ID NO: 2872 - DNA, 13 bp, Artificial Sequence
  synthetic sequence
tcaaccaagcacc

SEQ ID NO: 2873 - DNA, 13 bp, Artificial Sequence
  synthetic sequence
gcgatcggtcgtc

SEQ ID NO: 2874 - DNA, 13 bp, Artificial Sequence
  synthetic sequence
acagtcattggtg

SEQ ID NO: 2875 - DNA, 13 bp, Artificial Sequence
  synthetic sequence
gccagagccgcac

SEQ ID NO: 2876 - DNA, 13 bp, Artificial Sequence
  synthetic sequence
ggtatgaagtcaa

SEQ ID NO: 2877 - DNA, 13 bp, Artificial Sequence
  synthetic sequence
cgccgcatgggca

SEQ ID NO: 2878 - DNA, 13 bp, Artificial Sequence
  synthetic sequence
tggccgacaagaa

SEQ ID NO: 2879 - DNA, 13 bp, Artificial Sequence
  synthetic sequence
ccccagttgtatg

SEQ ID NO: 2880 - DNA, 13 bp, Artificial Sequence
  synthetic sequence
gctgacaactggc

SEQ ID NO: 2881 - DNA, 13 bp, Artificial Sequence
  synthetic sequence
tcaactcatacca

SEQ ID NO: 2882 - DNA, 13 bp, Artificial Sequence
  synthetic sequence
actgtggtctcag

SEQ ID NO: 2883 - DNA, 13 bp, Artificial Sequence
  synthetic sequence
gttgtaaaggagc

SEQ ID NO: 2884 - DNA, 13 bp, Artificial Sequence
  synthetic sequence
cccggagtctcac

SEQ ID NO: 2885 - DNA, 13 bp, Artificial Sequence
  synthetic sequence
aggttaccttctt

SEQ ID NO: 2886 - DNA, 13 bp, Artificial Sequence
  synthetic sequence
ttagagtccgaat

SEQ ID NO: 2887 - DNA, 13 bp, Artificial Sequence
  synthetic sequence
cctgaccgtatgt

SEQ ID NO: 2888 - DNA, 13 bp, Artificial Sequence
  synthetic sequence
gttaaccaaggcc

SEQ ID NO: 2889 - DNA, 13 bp, Artificial Sequence
  synthetic sequence
accaggcacagca

SEQ ID NO: 2890 - DNA, 13 bp, Artificial Sequence
  synthetic sequence
tagaaaggcacct

SEQ ID NO: 2891 - DNA, 13 bp, Artificial Sequence
  synthetic sequence
cagaggagctagc

SEQ ID NO: 2892 - DNA, 13 bp, Artificial Sequence
  synthetic sequence
aaggtgaaaagct

SEQ ID NO: 2893 - DNA, 13 bp, Artificial Sequence
  synthetic sequence
aaggatggaacat

SEQ ID NO: 2894 - DNA, 13 bp, Artificial Sequence
  synthetic sequence
tttttgccatgat

SEQ ID NO: 2895 - DNA, 13 bp, Artificial Sequence
  synthetic sequence
tgtgccttcagat

SEQ ID NO: 2896 - DNA, 13 bp, Artificial Sequence
  synthetic sequence
gacggaggggagc

SEQ ID NO: 2897 - DNA, 13 bp, Artificial Sequence
  synthetic sequence
cctttcaattatg

SEQ ID NO: 2898 - DNA, 13 bp, Artificial Sequence
  synthetic sequence
ggctcaccctcaa

SEQ ID NO: 2899 - DNA, 13 bp, Artificial Sequence
  synthetic sequence
ggcaacgcgagga

SEQ ID NO: 2900 - DNA, 13 bp, Artificial Sequence
  synthetic sequence
gggttaccaggca

SEQ ID NO: 2901 - DNA, 13 bp, Artificial Sequence
  synthetic sequence
aggggacctctcc

SEQ ID NO: 2902 - DNA, 13 bp, Artificial Sequence
  synthetic sequence
agtccgagccggg

SEQ ID NO: 2903 - DNA, 13 bp, Artificial Sequence
  synthetic sequence
atgtcccccccgc

SEQ ID NO: 2904 - DNA, 13 bp, Artificial Sequence
  synthetic sequence
tagacccttttgc

SEQ ID NO: 2905 - DNA, 13 bp, Artificial Sequence
  synthetic sequence
aagcaggagtagg

SEQ ID NO: 2906 - DNA, 13 bp, Artificial Sequence
  synthetic sequence
gcaggatttctgc

SEQ ID NO: 2907 - DNA, 13 bp, Artificial Sequence
  synthetic sequence
acggagtcgaagt

SEQ ID NO: 2908 - DNA, 13 bp, Artificial Sequence
  synthetic sequence
gtggtaaaggagc

SEQ ID NO: 2909 - DNA, 13 bp, Artificial Sequence
  synthetic sequence
ttgggtctctggt

SEQ ID NO: 2910 - DNA, 13 bp, Artificial Sequence
  synthetic sequence
cgatggcattcag

SEQ ID NO: 2911 - DNA, 13 bp, Artificial Sequence
  synthetic sequence
tgaagagctgccc

SEQ ID NO: 2912 - DNA, 13 bp, Artificial Sequence
  synthetic sequence
catggagtgagaa

SEQ ID NO: 2913 - DNA, 13 bp, Artificial Sequence
  synthetic sequence
tggtgagggagcc

SEQ ID NO: 2914 - DNA, 13 bp, Artificial Sequence
  synthetic sequence
gtgatagcgcccc

SEQ ID NO: 2915 - DNA, 13 bp, Artificial Sequence
  synthetic sequence
tctccgctggtgt

SEQ ID NO: 2916 - DNA, 13 bp, Artificial Sequence
  synthetic sequence
ggtgaatcaagcc

SEQ ID NO: 2917 - DNA, 13 bp, Artificial Sequence
  synthetic sequence
tgacgatgacctt

SEQ ID NO: 2918 - DNA, 13 bp, Artificial Sequence
  synthetic sequence
gcttgagacggat

SEQ ID NO: 2919 - DNA, 13 bp, Artificial Sequence
  synthetic sequence
ctttgatgtaaca

SEQ ID NO: 2920 - DNA, 13 bp, Artificial Sequence
  synthetic sequence
ccttcacatagca

SEQ ID NO: 2921 - DNA, 13 bp, Artificial Sequence
  synthetic sequence
ggcagggtggata

SEQ ID NO: 2922 - DNA, 13 bp, Artificial Sequence
  synthetic sequence
gccgatagctggc

SEQ ID NO: 2923 - DNA, 13 bp, Artificial Sequence
  synthetic sequence
tagtgatggtaag

SEQ ID NO: 2924 - DNA, 13 bp, Artificial Sequence
  synthetic sequence
ggccgaagctctt

SEQ ID NO: 2925 - DNA, 13 bp, Artificial Sequence
  synthetic sequence
tgaacatttggcc

SEQ ID NO: 2926 - DNA, 13 bp, Artificial Sequence
  synthetic sequence
gagtcaaaatcgc

SEQ ID NO: 2927 - DNA, 13 bp, Artificial Sequence
  synthetic sequence
ggatgacagcgtc

SEQ ID NO: 2928 - DNA, 13 bp, Artificial Sequence
  synthetic sequence
ccgtggagtcgtt

SEQ ID NO: 2929 - DNA, 13 bp, Artificial Sequence
  synthetic sequence
gacagggcgggca

SEQ ID NO: 2930 - DNA, 13 bp, Artificial Sequence
  synthetic sequence
cgcgcacacccaa

SEQ ID NO: 2931 - DNA, 13 bp, Artificial Sequence
  synthetic sequence
gagcaatcgttgg

SEQ ID NO: 2932 - DNA, 13 bp, Artificial Sequence
  synthetic sequence
gtttcttgaagca

SEQ ID NO: 2933 - DNA, 13 bp, Artificial Sequence
  synthetic sequence
gaggcagggccaa

SEQ ID NO: 2934 - DNA, 13 bp, Artificial Sequence
  synthetic sequence
ccaggttccccct

SEQ ID NO: 2935 - DNA, 13 bp, Artificial Sequence
  synthetic sequence
tgagcataggctt

SEQ ID NO: 2936 - DNA, 13 bp, Artificial Sequence
  synthetic sequence
cacaccgctggta

SEQ ID NO: 2937 - DNA, 13 bp, Artificial Sequence
  synthetic sequence
gccctctggggca

SEQ ID NO: 2938 - DNA, 13 bp, Artificial Sequence
  synthetic sequence
actttggcccagt

SEQ ID NO: 2939 - DNA, 13 bp, Artificial Sequence
  synthetic sequence
tattctgatggta

SEQ ID NO: 2940 - DNA, 13 bp, Artificial Sequence
  synthetic sequence
acgatccctgcag

SEQ ID NO: 2941 - DNA, 13 bp, Artificial Sequence
  synthetic sequence
cacaagtgcatgg

SEQ ID NO: 2942 - DNA, 13 bp, Artificial Sequence
  synthetic sequence
ccgacgagctggc

SEQ ID NO: 2943 - DNA, 13 bp, Artificial Sequence
  synthetic sequence
tggttgtaaatgt

SEQ ID NO: 2944 - DNA, 13 bp, Artificial Sequence
  synthetic sequence
ctgttgacaatgc

SEQ ID NO: 2945 - DNA, 13 bp, Artificial Sequence
  synthetic sequence
accgtggtctcag

SEQ ID NO: 2946 - DNA, 13 bp, Artificial Sequence
  synthetic sequence
ccgctagggcttt

SEQ ID NO: 2947 - DNA, 13 bp, Artificial Sequence
  synthetic sequence
agggaggggaccc

SEQ ID NO: 2948 - DNA, 13 bp, Artificial Sequence
  synthetic sequence
gccatggaggccc

SEQ ID NO: 2949 - DNA, 13 bp, Artificial Sequence
  synthetic sequence
caaccaacccctt

SEQ ID NO: 2950 - DNA, 13 bp, Artificial Sequence
  synthetic sequence
tgatttcgtcggc

SEQ ID NO: 2951 - DNA, 13 bp, Artificial Sequence
  synthetic sequence
catcgcccatggg

SEQ ID NO: 2952 - DNA, 13 bp, Artificial Sequence
  synthetic sequence
ctgttgatatgaa

SEQ ID NO: 2953 - DNA, 13 bp, Artificial Sequence
  synthetic sequence
agaggcttgaggc

SEQ ID NO: 2954 - DNA, 13 bp, Artificial Sequence
  synthetic sequence
actgttttgatgg

SEQ ID NO: 2955 - DNA, 13 bp, Artificial Sequence
  synthetic sequence
catgcgctctcgg

SEQ ID NO: 2956 - DNA, 13 bp, Artificial Sequence
  synthetic sequence
agtttgatagcac

SEQ ID NO: 2957 - DNA, 13 bp, Artificial Sequence
  synthetic sequence
gggaggctggcac

SEQ ID NO: 2958 - DNA, 13 bp, Artificial Sequence
  synthetic sequence
gggcaggagtgca

SEQ ID NO: 2959 - DNA, 13 bp, Artificial Sequence
  synthetic sequence
tccctgccattga

SEQ ID NO: 2960 - DNA, 13 bp, Artificial Sequence
  synthetic sequence
aaccctggtgcga

SEQ ID NO: 2961 - DNA, 13 bp, Artificial Sequence
  synthetic sequence
acatttcatgccg

SEQ ID NO: 2962 - DNA, 13 bp, Artificial Sequence
  synthetic sequence
agggtgatgattc

SEQ ID NO: 2963 - DNA, 13 bp, Artificial Sequence
  synthetic sequence
tgcgaaagttaac

SEQ ID NO: 2964 - DNA, 13 bp, Artificial Sequence
  synthetic sequence
gggaacactaaca

SEQ ID NO: 2965 - DNA, 13 bp, Artificial Sequence
  synthetic sequence
tggaggttgagca

SEQ ID NO: 2966 - DNA, 13 bp, Artificial Sequence
  synthetic sequence
gctgagtatgatc

SEQ ID NO: 2967 - DNA, 13 bp, Artificial Sequence
  synthetic sequence
tggagcttgagca

SEQ ID NO: 2968 - DNA, 13 bp, Artificial Sequence
  synthetic sequence
ctgagcagctgcg

SEQ ID NO: 2969 - DNA, 13 bp, Artificial Sequence
  synthetic sequence
tataaccatgatg

SEQ ID NO: 2970 - DNA, 13 bp, Artificial Sequence
  synthetic sequence
ctgaggacacggc

SEQ ID NO: 2971 - DNA, 13 bp, Artificial Sequence
  synthetic sequence
tgtttgagtcaga

SEQ ID NO: 2972 - DNA, 13 bp, Artificial Sequence
  synthetic sequence
cctctgtgatacc

SEQ ID NO: 2973 - DNA, 13 bp, Artificial Sequence
  synthetic sequence
tttggaatcatcc

SEQ ID NO: 2974 - DNA, 13 bp, Artificial Sequence
  synthetic sequence
gggaggctggtac

SEQ ID NO: 2975 - DNA, 13 bp, Artificial Sequence
  synthetic sequence
ccgtgcgtaagcc

SEQ ID NO: 2976 - DNA, 13 bp, Artificial Sequence
  synthetic sequence
ttactgccggggt

SEQ ID NO: 2977 - DNA, 13 bp, Artificial Sequence
  synthetic sequence
cgtatggcggcac

SEQ ID NO: 2978 - DNA, 13 bp, Artificial Sequence
  synthetic sequence
gttatgagttccg

SEQ ID NO: 2979 - DNA, 13 bp, Artificial Sequence
  synthetic sequence
cctggatccgcac

SEQ ID NO: 2980 - DNA, 13 bp, Artificial Sequence
  synthetic sequence
catatctgggacc

SEQ ID NO: 2981 - DNA, 13 bp, Artificial Sequence
  synthetic sequence
ctgccgagtatga

SEQ ID NO: 2982 - DNA, 13 bp, Artificial Sequence
  synthetic sequence
agcggaaggccgt

SEQ ID NO: 2983 - DNA, 13 bp, Artificial Sequence
  synthetic sequence
atttgacacctgg

SEQ ID NO: 2984 - DNA, 13 bp, Artificial Sequence
  synthetic sequence
aggctcctggcat

SEQ ID NO: 2985 - DNA, 13 bp, Artificial Sequence
  synthetic sequence
acaacaggtgaga

SEQ ID NO: 2986 - DNA, 13 bp, Artificial Sequence
  synthetic sequence
cttcatgcggtgg

SEQ ID NO: 2987 - DNA, 13 bp, Artificial Sequence
  synthetic sequence
tttctgagtttga

SEQ ID NO: 2988 - DNA, 13 bp, Artificial Sequence
  synthetic sequence
ctgatgttaggat

SEQ ID NO: 2989 - DNA, 13 bp, Artificial Sequence
  synthetic sequence
atttgacacccgg

SEQ ID NO: 2990 - DNA, 13 bp, Artificial Sequence
  synthetic sequence
tgcttcgacgggt

SEQ ID NO: 2991 - DNA, 13 bp, Artificial Sequence
  synthetic sequence
tatcaacatctcc

SEQ ID NO: 2992 - DNA, 13 bp, Artificial Sequence
  synthetic sequence
tggaaccacccaa

SEQ ID NO: 2993 - DNA, 13 bp, Artificial Sequence
  synthetic sequence
tccccgcttacgt

SEQ ID NO: 2994 - DNA, 13 bp, Artificial Sequence
  synthetic sequence
atgctgtcccggt

SEQ ID NO: 2995 - DNA, 13 bp, Artificial Sequence
  synthetic sequence
acctgctcccgcc

SEQ ID NO: 2996 - DNA, 13 bp, Artificial Sequence
  synthetic sequence
accctggtgcaat

SEQ ID NO: 2997 - DNA, 13 bp, Artificial Sequence
  synthetic sequence
agaggctcgaggc

SEQ ID NO: 2998 - DNA, 13 bp, Artificial Sequence
  synthetic sequence
ttatgaagtggct

SEQ ID NO: 2999 - DNA, 13 bp, Artificial Sequence
  synthetic sequence
tttaagggggatg

SEQ ID NO: 3000 - DNA, 13 bp, Artificial Sequence
  synthetic sequence
cgacagaattaat

SEQ ID NO: 3001 - DNA, 13 bp, Artificial Sequence
  synthetic sequence
atccccgccattg

SEQ ID NO: 3002 - DNA, 13 bp, Artificial Sequence
  synthetic sequence
gagtacgaccaga

SEQ ID NO: 3003 - DNA, 13 bp, Artificial Sequence
  synthetic sequence
tgtggaatcaccc

SEQ ID NO: 3004 - DNA, 13 bp, Artificial Sequence
  synthetic sequence
tttttgagtctga

SEQ ID NO: 3005 - DNA, 13 bp, Artificial Sequence
  synthetic sequence
gcacggccaacct

SEQ ID NO: 3006 - DNA, 13 bp, Artificial Sequence
  synthetic sequence
tgaattccatcac

SEQ ID NO: 3007 - DNA, 13 bp, Artificial Sequence
  synthetic sequence
acaaccatgacgt

SEQ ID NO: 3008 - DNA, 13 bp, Artificial Sequence
  synthetic sequence
gagtttgacagta

SEQ ID NO: 3009 - DNA, 13 bp, Artificial Sequence
  synthetic sequence
attaccagttcac

SEQ ID NO: 3010 - DNA, 13 bp, Artificial Sequence
  synthetic sequence
cagaaagattgta

SEQ ID NO: 3011 - DNA, 13 bp, Artificial Sequence
  synthetic sequence
cagaacaatttct

SEQ ID NO: 3012 - DNA, 13 bp, Artificial Sequence
  synthetic sequence
ctcacgtcatctg

SEQ ID NO: 3013 - DNA, 13 bp, Artificial Sequence
  synthetic sequence
aatgagctggagc

SEQ ID NO: 3014 - DNA, 13 bp, Artificial Sequence
  synthetic sequence
tttgggaggccgg

SEQ ID NO: 3015 - DNA, 13 bp, Artificial Sequence
  synthetic sequence
ataaccacgatgt

SEQ ID NO: 3016 - DNA, 13 bp, Artificial Sequence
  synthetic sequence
tttgtgatttcct

SEQ ID NO: 3017 - DNA, 13 bp, Artificial Sequence
  synthetic sequence
agccagcgaaagg

SEQ ID NO: 3018 - DNA, 13 bp, Artificial Sequence
  synthetic sequence
agtatgaccagac

SEQ ID NO: 3019 - DNA, 13 bp, Artificial Sequence
  synthetic sequence
tgccgggcttgac

SEQ ID NO: 3020 - DNA, 13 bp, Artificial Sequence
  synthetic sequence
caccgcccgtcag

SEQ ID NO: 3021 - DNA, 13 bp, Artificial Sequence
  synthetic sequence
gctgctttatgcg

SEQ ID NO: 3022 - DNA, 13 bp, Artificial Sequence
  synthetic sequence
gagtttgatagta

SEQ ID NO: 3023 - DNA, 13 bp, Artificial Sequence
  synthetic sequence
ctataactgagga

SEQ ID NO: 3024 - DNA, 13 bp, Artificial Sequence
  synthetic sequence
acagtccacgagg

SEQ ID NO: 3025 - DNA, 13 bp, Artificial Sequence
  synthetic sequence
agcagctccgcct

SEQ ID NO: 3026 - DNA, 13 bp, Artificial Sequence
  synthetic sequence
accagtttaccgc

SEQ ID NO: 3027 - DNA, 13 bp, Artificial Sequence
  synthetic sequence
aaaggtgatgatt

SEQ ID NO: 3028 - DNA, 13 bp, Artificial Sequence
  synthetic sequence
catatttgggacc

SEQ ID NO: 3029 - DNA, 13 bp, Artificial Sequence
  synthetic sequence
gggctgttctgtt

SEQ ID NO: 3030 - DNA, 13 bp, Artificial Sequence
  synthetic sequence
gccctcggcctat

SEQ ID NO: 3031 - DNA, 13 bp, Artificial Sequence
  synthetic sequence
gccagcgcaaggc

SEQ ID NO: 3032 - DNA, 13 bp, Artificial Sequence
  synthetic sequence
tgggaagctggca

SEQ ID NO: 3033 - DNA, 13 bp, Artificial Sequence
  synthetic sequence
ttgccgcccgagc

SEQ ID NO: 3034 - DNA, 13 bp, Artificial Sequence
  synthetic sequence
ccggactcgactg

SEQ ID NO: 3035 - DNA, 13 bp, Artificial Sequence
  synthetic sequence
ggcgaccccaacc

SEQ ID NO: 3036 - DNA, 13 bp, Artificial Sequence
  synthetic sequence
gggagacgtgctc

SEQ ID NO: 3037 - DNA, 13 bp, Artificial Sequence
  synthetic sequence
accgccacagtaa

SEQ ID NO: 3038 - DNA, 13 bp, Artificial Sequence
  synthetic sequence
acattcttccaga

SEQ ID NO: 3039 - DNA, 13 bp, Artificial Sequence
  synthetic sequence
ttgagcatgccca

SEQ ID NO: 3040 - DNA, 13 bp, Artificial Sequence
  synthetic sequence
cttggcgacccga

SEQ ID NO: 3041 - DNA, 13 bp, Artificial Sequence
  synthetic sequence
atcatgatgtgtc

SEQ ID NO: 3042 - DNA, 13 bp, Artificial Sequence
  synthetic sequence
tattgttttgacg

SEQ ID NO: 3043 - DNA, 13 bp, Artificial Sequence
  synthetic sequence
actgttgagctcg

SEQ ID NO: 3044 - DNA, 13 bp, Artificial Sequence
  synthetic sequence
ccatcagtcatac

SEQ ID NO: 3045 - DNA, 13 bp, Artificial Sequence
  synthetic sequence
ccataacccacca

SEQ ID NO: 3046 - DNA, 13 bp, Artificial Sequence
  synthetic sequence
ccggctcgctgtt

SEQ ID NO: 3047 - DNA, 13 bp, Artificial Sequence
  synthetic sequence
tttaaaggggatg

SEQ ID NO: 3048 - DNA, 13 bp, Artificial Sequence
  synthetic sequence
tctggaatcatcc

SEQ ID NO: 3049 - DNA, 13 bp, Artificial Sequence
  synthetic sequence
gtccatgaggccc

SEQ ID NO: 3050 - DNA, 13 bp, Artificial Sequence
  synthetic sequence
ctgagtacgatca

SEQ ID NO: 3051 - DNA, 13 bp, Artificial Sequence
  synthetic sequence
gtccatgaagccc

SEQ ID NO: 3052 - DNA, 13 bp, Artificial Sequence
  synthetic sequence
cagaaagactgta

SEQ ID NO: 3053 - DNA, 13 bp, Artificial Sequence
  synthetic sequence
gcaacccccgatg

SEQ ID NO: 3054 - DNA, 13 bp, Artificial Sequence
  synthetic sequence
gttttatgcggtg

SEQ ID NO: 3055 - DNA, 13 bp, Artificial Sequence
  synthetic sequence
catctgttgcttc

SEQ ID NO: 3056 - DNA, 13 bp, Artificial Sequence
  synthetic sequence
tgtttgagtcgga

SEQ ID NO: 3057 - DNA, 13 bp, Artificial Sequence
  synthetic sequence
accgttgagcttg

SEQ ID NO: 3058 - DNA, 13 bp, Artificial Sequence
  synthetic sequence
cgtatggctgccc

SEQ ID NO: 3059 - DNA, 13 bp, Artificial Sequence
  synthetic sequence
tctttctgggagg

SEQ ID NO: 3060 - DNA, 13 bp, Artificial Sequence
  synthetic sequence
gacccaaatcaga

SEQ ID NO: 3061 - DNA, 13 bp, Artificial Sequence
  synthetic sequence
gtccctgtgcata

SEQ ID NO: 3062 - DNA, 13 bp, Artificial Sequence
  synthetic sequence
tctaaaggcatgc

SEQ ID NO: 3063 - DNA, 13 bp, Artificial Sequence
  synthetic sequence
acatctactattg

SEQ ID NO: 3064 - DNA, 13 bp, Artificial Sequence
  synthetic sequence
ttggtcgcatccg

SEQ ID NO: 3065 - DNA, 13 bp, Artificial Sequence
  synthetic sequence
gagcctggcgtcg

SEQ ID NO: 3066 - DNA, 13 bp, Artificial Sequence
  synthetic sequence
tgtctcagccaca

SEQ ID NO: 3067 - DNA, 13 bp, Artificial Sequence
  synthetic sequence
cccgtacagccaa

SEQ ID NO: 3068 - DNA, 13 bp, Artificial Sequence
  synthetic sequence
ttgccgccgagac

SEQ ID NO: 3069 - DNA, 13 bp, Artificial Sequence
  synthetic sequence
tattgctttgatg

SEQ ID NO: 3070 - DNA, 13 bp, Artificial Sequence
  synthetic sequence
ttcatgaggccca

SEQ ID NO: 3071 - DNA, 13 bp, Artificial Sequence
  synthetic sequence
cttgagcttgagt

SEQ ID NO: 3072 - DNA, 13 bp, Artificial Sequence
  synthetic sequence
tacaaccatgatg

SEQ ID NO: 3073 - DNA, 13 bp, Artificial Sequence
  synthetic sequence
agtcagcgtaagg

SEQ ID NO: 3074 - DNA, 13 bp, Artificial Sequence
  synthetic sequence
gcgcccatctgtt

SEQ ID NO: 3075 - DNA, 13 bp, Artificial Sequence
  synthetic sequence
accagatccctgc

SEQ ID NO: 3076 - DNA, 13 bp, Artificial Sequence
  synthetic sequence
gctgaatatgacc

SEQ ID NO: 3077 - DNA, 13 bp, Artificial Sequence
  synthetic sequence
gctaccgttgaag

SEQ ID NO: 3078 - DNA, 13 bp, Artificial Sequence
  synthetic sequence
tcactgccggggt

SEQ ID NO: 3079 - DNA, 13 bp, Artificial Sequence
  synthetic sequence
agctcgagtttcg

SEQ ID NO: 3080 - DNA, 13 bp, Artificial Sequence
  synthetic sequence
attgttttgatgg

SEQ ID NO: 3081 - DNA, 13 bp, Artificial Sequence
  synthetic sequence
acccaggctatat

SEQ ID NO: 3082 - DNA, 13 bp, Artificial Sequence
  synthetic sequence
tctttcagaagga

SEQ ID NO: 3083 - DNA, 13 bp, Artificial Sequence
  synthetic sequence
taacggctactgt

SEQ ID NO: 3084 - DNA, 13 bp, Artificial Sequence
  synthetic sequence
gccgggcttgatt

SEQ ID NO: 3085 - DNA, 13 bp, Artificial Sequence
  synthetic sequence
tgttcgagtcaga

SEQ ID NO: 3086 - DNA, 13 bp, Artificial Sequence
  synthetic sequence
tggttcagcagtt

SEQ ID NO: 3087 - DNA, 13 bp, Artificial Sequence
  synthetic sequence
tgtttgaatcaga

SEQ ID NO: 3088 - DNA, 13 bp, Artificial Sequence
  synthetic sequence
gacatgaattcta

SEQ ID NO: 3089 - DNA, 13 bp, Artificial Sequence
  synthetic sequence
gagtccgagtgta

SEQ ID NO: 3090 - DNA, 13 bp, Artificial Sequence
  synthetic sequence
tttggaatcaccc

SEQ ID NO: 3091 - DNA, 13 bp, Artificial Sequence
  synthetic sequence
agtttgacagcac

SEQ ID NO: 3092 - DNA, 13 bp, Artificial Sequence
  synthetic sequence
accaacacccgtg

SEQ ID NO: 3093 - DNA, 13 bp, Artificial Sequence
  synthetic sequence
gctatgagttccg

SEQ ID NO: 3094 - DNA, 13 bp, Artificial Sequence
  synthetic sequence
gccaccatcgccc

SEQ ID NO: 3095 - DNA, 13 bp, Artificial Sequence
  synthetic sequence
tgtttgagtctga

SEQ ID NO: 3096 - DNA, 13 bp, Artificial Sequence
  synthetic sequence
atgaattccgtga

SEQ ID NO: 3097 - DNA, 13 bp, Artificial Sequence
  synthetic sequence
acctccactgatg

SEQ ID NO: 3098 - DNA, 13 bp, Artificial Sequence
  synthetic sequence
atggaggcccatc

SEQ ID NO: 3099 - DNA, 13 bp, Artificial Sequence
  synthetic sequence
gtatggccgcccc

SEQ ID NO: 3100 - DNA, 13 bp, Artificial Sequence
  synthetic sequence
aaccctgatcaga

SEQ ID NO: 3101 - DNA, 13 bp, Artificial Sequence
  synthetic sequence
ccttctgggaggc

SEQ ID NO: 3102 - DNA, 13 bp, Artificial Sequence
  synthetic sequence
tggagcttgaaca

SEQ ID NO: 3103 - DNA, 13 bp, Artificial Sequence
  synthetic sequence
caccccctgtgcc

SEQ ID NO: 3104 - DNA, 13 bp, Artificial Sequence
  synthetic sequence
ggtgcccctagcg

SEQ ID NO: 3105 - DNA, 13 bp, Artificial Sequence
  synthetic sequence
actattactgagg

SEQ ID NO: 3106 - DNA, 13 bp, Artificial Sequence
  synthetic sequence
taccagtttactg

SEQ ID NO: 3107 - DNA, 13 bp, Artificial Sequence
  synthetic sequence
tcccgctgcgcct

SEQ ID NO: 3108 - DNA, 13 bp, Artificial Sequence
  synthetic sequence
gatgtggtgtggg

SEQ ID NO: 3109 - DNA, 13 bp, Artificial Sequence
  synthetic sequence
tgcccccactcgg

SEQ ID NO: 3110 - DNA, 13 bp, Artificial Sequence
  synthetic sequence
ttgagttccgcaa

SEQ ID NO: 3111 - DNA, 13 bp, Artificial Sequence
  synthetic sequence
aagcggcttgagg

SEQ ID NO: 3112 - DNA, 13 bp, Artificial Sequence
  synthetic sequence
tgacggctactgt

SEQ ID NO: 3113 - DNA, 13 bp, Artificial Sequence
  synthetic sequence
actatcagtttac

SEQ ID NO: 3114 - DNA, 13 bp, Artificial Sequence
  synthetic sequence
atatctgggatcg

SEQ ID NO: 3115 - DNA, 13 bp, Artificial Sequence
  synthetic sequence
tatgctggctccc

SEQ ID NO: 3116 - DNA, 13 bp, Artificial Sequence
  synthetic sequence
actggcactaatc

SEQ ID NO: 3117 - DNA, 13 bp, Artificial Sequence
  synthetic sequence
gtccctcagtcct

SEQ ID NO: 3118 - DNA, 13 bp, Artificial Sequence
  synthetic sequence
cagtgacggtcca

SEQ ID NO: 3119 - DNA, 13 bp, Artificial Sequence
  synthetic sequence
caccttcttggtg

SEQ ID NO: 3120 - DNA, 13 bp, Artificial Sequence
  synthetic sequence
accctggcgcgat

SEQ ID NO: 3121 - DNA, 13 bp, Artificial Sequence
  synthetic sequence
gccaccatgcgcc

SEQ ID NO: 3122 - DNA, 13 bp, Artificial Sequence
  synthetic sequence
gagtatcgcaacc

SEQ ID NO: 3123 - DNA, 13 bp, Artificial Sequence
  synthetic sequence
agtatgaccaaac

SEQ ID NO: 3124 - DNA, 13 bp, Artificial Sequence
  synthetic sequence
ctgtttgtgactt

SEQ ID NO: 3125 - DNA, 13 bp, Artificial Sequence
  synthetic sequence
cctcaggcactaa

SEQ ID NO: 3126 - DNA, 13 bp, Artificial Sequence
  synthetic sequence
ttcatgaagtggc

SEQ ID NO: 3127 - DNA, 13 bp, Artificial Sequence
  synthetic sequence
gctatgaatttcg

SEQ ID NO: 3128 - DNA, 13 bp, Artificial Sequence
  synthetic sequence
gcacggctaacct

SEQ ID NO: 3129 - DNA, 13 bp, Artificial Sequence
  synthetic sequence
tctggaatcaccc

SEQ ID NO: 3130 - DNA, 13 bp, Artificial Sequence
  synthetic sequence
ttgttctcttgct

SEQ ID NO: 3131 - DNA, 13 bp, Artificial Sequence
  synthetic sequence
ggaaccaccctat

SEQ ID NO: 3132 - DNA, 13 bp, Artificial Sequence
  synthetic sequence
aatggcctagact

SEQ ID NO: 3133 - DNA, 13 bp, Artificial Sequence
  synthetic sequence
agttcaccgccgg

SEQ ID NO: 3134 - DNA, 13 bp, Artificial Sequence
  synthetic sequence
gtacggcgaacct

SEQ ID NO: 3135 - DNA, 13 bp, Artificial Sequence
  synthetic sequence
gggaagctggtac

SEQ ID NO: 3136 - DNA, 13 bp, Artificial Sequence
  synthetic sequence
gctgaatatgatc

SEQ ID NO: 3137 - DNA, 13 bp, Artificial Sequence
  synthetic sequence
actactaaagccg

SEQ ID NO: 3138 - DNA, 13 bp, Artificial Sequence
  synthetic sequence
acaaccacgatgt

SEQ ID NO: 3139 - DNA, 13 bp, Artificial Sequence
  synthetic sequence
agacttgctcccg

SEQ ID NO: 3140 - DNA, 13 bp, Artificial Sequence
  synthetic sequence
aaccaaatccctg

SEQ ID NO: 3141 - DNA, 13 bp, Artificial Sequence
  synthetic sequence
catatttgggata

SEQ ID NO: 3142 - DNA, 13 bp, Artificial Sequence
  synthetic sequence
gctacaatcatga

SEQ ID NO: 3143 - DNA, 13 bp, Artificial Sequence
  synthetic sequence
tgacggccactgt

SEQ ID NO: 3144 - DNA, 13 bp, Artificial Sequence
  synthetic sequence
tctgctgttttat

SEQ ID NO: 3145 - DNA, 13 bp, Artificial Sequence
  synthetic sequence
tttggaaccatcc

SEQ ID NO: 3146 - DNA, 13 bp, Artificial Sequence
  synthetic sequence
gcatgaccccatg

SEQ ID NO: 3147 - DNA, 13 bp, Artificial Sequence
  synthetic sequence
gttcacgaggccc

SEQ ID NO: 3148 - DNA, 13 bp, Artificial Sequence
  synthetic sequence
acatctgggaccg

SEQ ID NO: 3149 - DNA, 13 bp, Artificial Sequence
  synthetic sequence
gggaacaccaata

SEQ ID NO: 3150 - DNA, 13 bp, Artificial Sequence
  synthetic sequence
gcaggttacaatc

SEQ ID NO: 3151 - DNA, 13 bp, Artificial Sequence
  synthetic sequence
ccactgtcgagct

SEQ ID NO: 3152 - DNA, 13 bp, Artificial Sequence
  synthetic sequence
gctatatctaagg

SEQ ID NO: 3153 - DNA, 13 bp, Artificial Sequence
  synthetic sequence
aggaccttgagca

SEQ ID NO: 3154 - DNA, 13 bp, Artificial Sequence
  synthetic sequence
cgtatggcggcgc

SEQ ID NO: 3155 - DNA, 13 bp, Artificial Sequence
  synthetic sequence
actataaccgagg

SEQ ID NO: 3156 - DNA, 13 bp, Artificial Sequence
  synthetic sequence
gccatcaccgccc

SEQ ID NO: 3157 - DNA, 13 bp, Artificial Sequence
  synthetic sequence
agacctgttcccg

SEQ ID NO: 3158 - DNA, 13 bp, Artificial Sequence
  synthetic sequence
cagggcatttcta

SEQ ID NO: 3159 - DNA, 13 bp, Artificial Sequence
  synthetic sequence
tccttgcgaagat

SEQ ID NO: 3160 - DNA, 13 bp, Artificial Sequence
  synthetic sequence
ctaaaggtatgcg

SEQ ID NO: 3161 - DNA, 13 bp, Artificial Sequence
  synthetic sequence
catcgtaaagagt

SEQ ID NO: 3162 - DNA, 13 bp, Artificial Sequence
  synthetic sequence
aagtgtatgccgg

SEQ ID NO: 3163 - DNA, 13 bp, Artificial Sequence
  synthetic sequence
cttctggcaccaa

SEQ ID NO: 3164 - DNA, 13 bp, Artificial Sequence
  synthetic sequence
gcctctggaacta

SEQ ID NO: 3165 - DNA, 13 bp, Artificial Sequence
  synthetic sequence
tcgtgctcgtgct

SEQ ID NO: 3166 - DNA, 13 bp, Artificial Sequence
  synthetic sequence
gttataccgcgtg

SEQ ID NO: 3167 - DNA, 13 bp, Artificial Sequence
  synthetic sequence
gctgtctgtgact

SEQ ID NO: 3168 - DNA, 13 bp, Artificial Sequence
  synthetic sequence
tacagctagacac

SEQ ID NO: 3169 - DNA, 13 bp, Artificial Sequence
  synthetic sequence
ggctgaggaggcc

SEQ ID NO: 3170 - DNA, 13 bp, Artificial Sequence
  synthetic sequence
ttgctgctcgtgc

SEQ ID NO: 3171 - DNA, 13 bp, Artificial Sequence
  synthetic sequence
ggagggcagatgt

SEQ ID NO: 3172 - DNA, 13 bp, Artificial Sequence
  synthetic sequence
gttgacatgaact

SEQ ID NO: 3173 - DNA, 13 bp, Artificial Sequence
  synthetic sequence
gctaatcctggtg

SEQ ID NO: 3174 - DNA, 13 bp, Artificial Sequence
  synthetic sequence
ttttccagaagga

SEQ ID NO: 3175 - DNA, 13 bp, Artificial Sequence
  synthetic sequence
gctacgagttccg

SEQ ID NO: 3176 - DNA, 13 bp, Artificial Sequence
  synthetic sequence
gaatttgatagca

SEQ ID NO: 3177 - DNA, 13 bp, Artificial Sequence
  synthetic sequence
gtttcaccccggt

SEQ ID NO: 3178 - DNA, 13 bp, Artificial Sequence
  synthetic sequence
gttcatgaagccc

SEQ ID NO: 3179 - DNA, 13 bp, Artificial Sequence
  synthetic sequence
gtgaccccaacca

SEQ ID NO: 3180 - DNA, 13 bp, Artificial Sequence
  synthetic sequence
tggactgtaccgc

SEQ ID NO: 3181 - DNA, 13 bp, Artificial Sequence
  synthetic sequence
ataccccgcggca

SEQ ID NO: 3182 - DNA, 13 bp, Artificial Sequence
  synthetic sequence
cttgcaagtcccg

SEQ ID NO: 3183 - DNA, 13 bp, Artificial Sequence
  synthetic sequence
ttgctgcccgagc

SEQ ID NO: 3184 - DNA, 13 bp, Artificial Sequence
  synthetic sequence
gcaacattccccc

SEQ ID NO: 3185 - DNA, 13 bp, Artificial Sequence
  synthetic sequence
ccgaacagttgcg

SEQ ID NO: 3186 - DNA, 13 bp, Artificial Sequence
  synthetic sequence
gccagcggaaagc

SEQ ID NO: 3187 - DNA, 13 bp, Artificial Sequence
  synthetic sequence
acccgaaccagat

SEQ ID NO: 3188 - DNA, 13 bp, Artificial Sequence
  synthetic sequence
gtgtccctggctc

SEQ ID NO: 3189 - DNA, 13 bp, Artificial Sequence
  synthetic sequence
tttcatgcggtgg

SEQ ID NO: 3190 - DNA, 13 bp, Artificial Sequence
  synthetic sequence
tccccgctcacgt

SEQ ID NO: 3191 - DNA, 13 bp, Artificial Sequence
  synthetic sequence
ttatgaaatggct

SEQ ID NO: 3192 - DNA, 13 bp, Artificial Sequence
  synthetic sequence
gaggtttctgatg

SEQ ID NO: 3193 - DNA, 13 bp, Artificial Sequence
  synthetic sequence
gatgtgctttggc

SEQ ID NO: 3194 - DNA, 13 bp, Artificial Sequence
  synthetic sequence
cataagccaccgg

SEQ ID NO: 3195 - DNA, 13 bp, Artificial Sequence
  synthetic sequence
ggtggcgccccta

SEQ ID NO: 3196 - DNA, 13 bp, Artificial Sequence
  synthetic sequence
aggggatgaaaag

SEQ ID NO: 3197 - DNA, 13 bp, Artificial Sequence
  synthetic sequence
ccaccagcaccag

SEQ ID NO: 3198 - DNA, 13 bp, Artificial Sequence
  synthetic sequence
ccgttgatatgaa

SEQ ID NO: 3199 - DNA, 13 bp, Artificial Sequence
  synthetic sequence
gctactgtcgagc

SEQ ID NO: 3200 - DNA, 13 bp, Artificial Sequence
  synthetic sequence
gctatgagtttcg

SEQ ID NO: 3201 - DNA, 13 bp, Artificial Sequence
  synthetic sequence
tgtccacgtctcc

SEQ ID NO: 3202 - DNA, 13 bp, Artificial Sequence
  synthetic sequence
gggcctgtgaggt

SEQ ID NO: 3203 - DNA, 13 bp, Artificial Sequence
  synthetic sequence
accattactgagg

SEQ ID NO: 3204 - DNA, 13 bp, Artificial Sequence
  synthetic sequence
ttgcggcccgtgc

SEQ ID NO: 3205 - DNA, 13 bp, Artificial Sequence
  synthetic sequence
tggaaccacccga

SEQ ID NO: 3206 - DNA, 13 bp, Artificial Sequence
  synthetic sequence
ctgtgcgtaagcc

SEQ ID NO: 3207 - DNA, 13 bp, Artificial Sequence
  synthetic sequence
ccaccgttgaggt

SEQ ID NO: 3208 - DNA, 13 bp, Artificial Sequence
  synthetic sequence
gacggcgctaagg

SEQ ID NO: 3209 - DNA, 13 bp, Artificial Sequence
  synthetic sequence
accaacactcgtg

SEQ ID NO: 3210 - DNA, 13 bp, Artificial Sequence
  synthetic sequence
ctaaagggatgaa

SEQ ID NO: 3211 - DNA, 13 bp, Artificial Sequence
  synthetic sequence
actgcaaggctgt

SEQ ID NO: 3212 - DNA, 13 bp, Artificial Sequence
  synthetic sequence
tccagaaagactg

SEQ ID NO: 3213 - DNA, 13 bp, Artificial Sequence
  synthetic sequence
agtccgagtgcac

SEQ ID NO: 3214 - DNA, 13 bp, Artificial Sequence
  synthetic sequence
ccaaccaatccct

SEQ ID NO: 3215 - DNA, 13 bp, Artificial Sequence
  synthetic sequence
cagcgcaaagcgg

SEQ ID NO: 3216 - DNA, 13 bp, Artificial Sequence
  synthetic sequence
actgctttgatgg

SEQ ID NO: 3217 - DNA, 13 bp, Artificial Sequence
  synthetic sequence
ggcagtcttcccc

SEQ ID NO: 3218 - DNA, 13 bp, Artificial Sequence
  synthetic sequence
cccgtacggccaa

SEQ ID NO: 3219 - DNA, 13 bp, Artificial Sequence
  synthetic sequence
ctcgagcttgagt

SEQ ID NO: 3220 - DNA, 13 bp, Artificial Sequence
  synthetic sequence
tgctttgacgggt

SEQ ID NO: 3221 - DNA, 13 bp, Artificial Sequence
  synthetic sequence
gttcataagccac

SEQ ID NO: 3222 - DNA, 13 bp, Artificial Sequence
  synthetic sequence
catgcgccctagg

SEQ ID NO: 3223 - DNA, 13 bp, Artificial Sequence
  synthetic sequence
cttcgtggtaagc

SEQ ID NO: 3224 - DNA, 13 bp, Artificial Sequence
  synthetic sequence
ttgtgtgggtgac

SEQ ID NO: 3225 - DNA, 13 bp, Artificial Sequence
  synthetic sequence
cttccgtggccac

SEQ ID NO: 3226 - DNA, 13 bp, Artificial Sequence
  synthetic sequence
cgcatggctgctc

SEQ ID NO: 3227 - DNA, 13 bp, Artificial Sequence
  synthetic sequence
tggaaccacccca

SEQ ID NO: 3228 - DNA, 13 bp, Artificial Sequence
  synthetic sequence
agcttgaatttag

SEQ ID NO: 3229 - DNA, 13 bp, Artificial Sequence
  synthetic sequence
gtgagaaggcccg

SEQ ID NO: 3230 - DNA, 13 bp, Artificial Sequence
  synthetic sequence
gatgatttctgcc

SEQ ID NO: 3231 - DNA, 13 bp, Artificial Sequence
  synthetic sequence
ccgtcggtcatac

SEQ ID NO: 3232 - DNA, 13 bp, Artificial Sequence
  synthetic sequence
gcttagattgtac

SEQ ID NO: 3233 - DNA, 13 bp, Artificial Sequence
  synthetic sequence
ttcgagtcggatt

SEQ ID NO: 3234 - DNA, 13 bp, Artificial Sequence
  synthetic sequence
aatcaaattcctg

SEQ ID NO: 3235 - DNA, 13 bp, Artificial Sequence
  synthetic sequence
aatcagatccctg

SEQ ID NO: 3236 - DNA, 13 bp, Artificial Sequence
  synthetic sequence
gtgttcccgggtc

SEQ ID NO: 3237 - DNA, 13 bp, Artificial Sequence
  synthetic sequence
tgcagcccgtaac

SEQ ID NO: 3238 - DNA, 13 bp, Artificial Sequence
  synthetic sequence
attatgccgaggt

SEQ ID NO: 3239 - DNA, 13 bp, Artificial Sequence
  synthetic sequence
cgtaccgtgagac

SEQ ID NO: 3240 - DNA, 13 bp, Artificial Sequence
  synthetic sequence
cactaccagttca

SEQ ID NO: 3241 - DNA, 13 bp, Artificial Sequence
  synthetic sequence
atagtccttgaca

SEQ ID NO: 3242 - DNA, 13 bp, Artificial Sequence
  synthetic sequence
agacatgctcccg

SEQ ID NO: 3243 - DNA, 13 bp, Artificial Sequence
  synthetic sequence
agctcgagttccg

SEQ ID NO: 3244 - DNA, 13 bp, Artificial Sequence
  synthetic sequence
aatttgacagtac

SEQ ID NO: 3245 - DNA, 13 bp, Artificial Sequence
  synthetic sequence
attagcttttggg

SEQ ID NO: 3246 - DNA, 13 bp, Artificial Sequence
  synthetic sequence
ctgtttagccaga

SEQ ID NO: 3247 - DNA, 13 bp, Artificial Sequence
  synthetic sequence
ggggtgtcaaggg

SEQ ID NO: 3248 - DNA, 13 bp, Artificial Sequence
  synthetic sequence
ccgtagaaaaggc

SEQ ID NO: 3249 - DNA, 13 bp, Artificial Sequence
  synthetic sequence
tctgagttcgata

SEQ ID NO: 3250 - DNA, 13 bp, Artificial Sequence
  synthetic sequence
tgggcatcaagcg

SEQ ID NO: 3251 - DNA, 13 bp, Artificial Sequence
  synthetic sequence
tgcgcgactttgt

SEQ ID NO: 3252 - DNA, 13 bp, Artificial Sequence
  synthetic sequence
tgttgctttatgc

SEQ ID NO: 3253 - DNA, 13 bp, Artificial Sequence
  synthetic sequence
gaggtcgagcatg

SEQ ID NO: 3254 - DNA, 13 bp, Artificial Sequence
  synthetic sequence
atggggatcaagc

SEQ ID NO: 3255 - DNA, 13 bp, Artificial Sequence
  synthetic sequence
ggcgcaccctgtg

SEQ ID NO: 3256 - DNA, 13 bp, Artificial Sequence
  synthetic sequence
agtaagccagcta

SEQ ID NO: 3257 - DNA, 13 bp, Artificial Sequence
  synthetic sequence
gcccgtctgttat

SEQ ID NO: 3258 - DNA, 13 bp, Artificial Sequence
  synthetic sequence
gtcaacgtaaggc

SEQ ID NO: 3259 - DNA, 13 bp, Artificial Sequence
  synthetic sequence
tgtccacatcccc

SEQ ID NO: 3260 - DNA, 13 bp, Artificial Sequence
  synthetic sequence
aaccagattcctg

SEQ ID NO: 3261 - DNA, 13 bp, Artificial Sequence
  synthetic sequence
atgtgcacaagcg

SEQ ID NO: 3262 - DNA, 13 bp, Artificial Sequence
  synthetic sequence
cttgactgtaagg

SEQ ID NO: 3263 - DNA, 13 bp, Artificial Sequence
  synthetic sequence
ccgcaagggctgc

SEQ ID NO: 3264 - DNA, 13 bp, Artificial Sequence
  synthetic sequence
cccgctattgatt

SEQ ID NO: 3265 - DNA, 13 bp, Artificial Sequence
  synthetic sequence
ttttactcccgcc

SEQ ID NO: 3266 - DNA, 13 bp, Artificial Sequence
  synthetic sequence
gtccatgaagctc

SEQ ID NO: 3267 - DNA, 13 bp, Artificial Sequence
  synthetic sequence
accctgtgcccag

SEQ ID NO: 3268 - DNA, 13 bp, Artificial Sequence
  synthetic sequence
caggtggccaagc

SEQ ID NO: 3269 - DNA, 13 bp, Artificial Sequence
  synthetic sequence
atccgatccagcg

SEQ ID NO: 3270 - DNA, 13 bp, Artificial Sequence
  synthetic sequence
atgcagtatgtga

SEQ ID NO: 3271 - DNA, 13 bp, Artificial Sequence
  synthetic sequence
ccgttctttcaac

SEQ ID NO: 3272 - DNA, 13 bp, Artificial Sequence
  synthetic sequence
gtgcagcctgtaa

SEQ ID NO: 3273 - DNA, 13 bp, Artificial Sequence
  synthetic sequence
ggaagcgcatcag

SEQ ID NO: 3274 - DNA, 13 bp, Artificial Sequence
  synthetic sequence
cagcatcgcccgt

SEQ ID NO: 3275 - DNA, 13 bp, Artificial Sequence
  synthetic sequence
tcaccccagaaac

SEQ ID NO: 3276 - DNA, 13 bp, Artificial Sequence
  synthetic sequence
acatgttattcat

SEQ ID NO: 3277 - DNA, 13 bp, Artificial Sequence
  synthetic sequence
actcccgggtttt

SEQ ID NO: 3278 - DNA, 13 bp, Artificial Sequence
  synthetic sequence
ttagaatactgct

SEQ ID NO: 3279 - DNA, 13 bp, Artificial Sequence
  synthetic sequence
gccatgttccaga

SEQ ID NO: 3280 - DNA, 13 bp, Artificial Sequence
  synthetic sequence
cccgctgcatgtg

SEQ ID NO: 3281 - DNA, 13 bp, Artificial Sequence
  synthetic sequence
tcagcaagattaa

SEQ ID NO: 3282 - DNA, 13 bp, Artificial Sequence
  synthetic sequence
gaatcaacatcag

SEQ ID NO: 3283 - DNA, 13 bp, Artificial Sequence
  synthetic sequence
gggccccaattct

SEQ ID NO: 3284 - DNA, 13 bp, Artificial Sequence
  synthetic sequence
ttctgctcaaccc

SEQ ID NO: 3285 - DNA, 13 bp, Artificial Sequence
  synthetic sequence
gggccccagttct

SEQ ID NO: 3286 - DNA, 13 bp, Artificial Sequence
  synthetic sequence
taaagtgtgctct

SEQ ID NO: 3287 - DNA, 13 bp, Artificial Sequence
  synthetic sequence
ggaggtagcgctg

SEQ ID NO: 3288 - DNA, 13 bp, Artificial Sequence
  synthetic sequence
aggaaaaagttat

SEQ ID NO: 3289 - DNA, 13 bp, Artificial Sequence
  synthetic sequence
taaggtgtattag

SEQ ID NO: 3290 - DNA, 13 bp, Artificial Sequence
  synthetic sequence
agaaggggttggc

SEQ ID NO: 3291 - DNA, 13 bp, Artificial Sequence
  synthetic sequence
cattctcaaaaac

SEQ ID NO: 3292 - DNA, 13 bp, Artificial Sequence
  synthetic sequence
catcaaaaacaag

SEQ ID NO: 3293 - DNA, 13 bp, Artificial Sequence
  synthetic sequence
gagtactgctgga

SEQ ID NO: 3294 - DNA, 13 bp, Artificial Sequence
  synthetic sequence
ctatgatcgccat

SEQ ID NO: 3295 - DNA, 13 bp, Artificial Sequence
  synthetic sequence
gtctggggccaaa

SEQ ID NO: 3296 - DNA, 13 bp, Artificial Sequence
  synthetic sequence
agaagcgtatcag

SEQ ID NO: 3297 - DNA, 13 bp, Artificial Sequence
  synthetic sequence
gcccgctgcatat

SEQ ID NO: 3298 - DNA, 13 bp, Artificial Sequence
  synthetic sequence
cactatcggacac

SEQ ID NO: 3299 - DNA, 13 bp, Artificial Sequence
  synthetic sequence
aaggggttagcag

SEQ ID NO: 3300 - DNA, 13 bp, Artificial Sequence
  synthetic sequence
ttagcctcaaacc

SEQ ID NO: 3301 - DNA, 13 bp, Artificial Sequence
  synthetic sequence
ccagggccaaata

SEQ ID NO: 3302 - DNA, 13 bp, Artificial Sequence
  synthetic sequence
gtcacaacagcac

SEQ ID NO: 3303 - DNA, 13 bp, Artificial Sequence
  synthetic sequence
agtcaacatcagg

SEQ ID NO: 3304 - DNA, 13 bp, Artificial Sequence
  synthetic sequence
acggcagagccgt

SEQ ID NO: 3305 - DNA, 13 bp, Artificial Sequence
  synthetic sequence
ccacaaaaaggat

SEQ ID NO: 3306 - DNA, 13 bp, Artificial Sequence
  synthetic sequence
gcagcatcgatct

SEQ ID NO: 3307 - DNA, 13 bp, Artificial Sequence
  synthetic sequence
catcacggctgca

SEQ ID NO: 3308 - DNA, 13 bp, Artificial Sequence
  synthetic sequence
ctcccgagtttta

SEQ ID NO: 3309 - DNA, 13 bp, Artificial Sequence
  synthetic sequence
cccagtttttctc

SEQ ID NO: 3310 - DNA, 13 bp, Artificial Sequence
  synthetic sequence
cattttcaaatac

SEQ ID NO: 3311 - DNA, 13 bp, Artificial Sequence
  synthetic sequence
acaccgaccgcag

SEQ ID NO: 3312 - DNA, 13 bp, Artificial Sequence
  synthetic sequence
acagcatggataa

SEQ ID NO: 3313 - DNA, 13 bp, Artificial Sequence
  synthetic sequence
gtgtcagcaaggt

SEQ ID NO: 3314 - DNA, 13 bp, Artificial Sequence
  synthetic sequence
cacactatcagac

SEQ ID NO: 3315 - DNA, 13 bp, Artificial Sequence
  synthetic sequence
catcaaaaacgag

SEQ ID NO: 3316 - DNA, 13 bp, Artificial Sequence
  synthetic sequence
ccccctcatatgt

SEQ ID NO: 3317 - DNA, 13 bp, Artificial Sequence
  synthetic sequence
ggctcattccaga

SEQ ID NO: 3318 - DNA, 13 bp, Artificial Sequence
  synthetic sequence
gggcctcaagctg

SEQ ID NO: 3319 - DNA, 13 bp, Artificial Sequence
  synthetic sequence
gccatattccaga

SEQ ID NO: 3320 - DNA, 13 bp, Artificial Sequence
  synthetic sequence
tggcctcaaacca

SEQ ID NO: 3321 - DNA, 13 bp, Artificial Sequence
  synthetic sequence
gcagtaatcacag

SEQ ID NO: 3322 - DNA, 13 bp, Artificial Sequence
  synthetic sequence
actatgtccgtga

SEQ ID NO: 3323 - DNA, 13 bp, Artificial Sequence
  synthetic sequence
atcctaacctgca

SEQ ID NO: 3324 - DNA, 13 bp, Artificial Sequence
  synthetic sequence
ggccagaaagaga

SEQ ID NO: 3325 - DNA, 13 bp, Artificial Sequence
  synthetic sequence
aggacaccgacag

SEQ ID NO: 3326 - DNA, 13 bp, Artificial Sequence
  synthetic sequence
cggcggcagttag

SEQ ID NO: 3327 - DNA, 13 bp, Artificial Sequence
  synthetic sequence
accggcggcagtt

SEQ ID NO: 3328 - DNA, 13 bp, Artificial Sequence
  synthetic sequence
agggtgtattagt

SEQ ID NO: 3329 - DNA, 13 bp, Artificial Sequence
  synthetic sequence
ccatgttccaaac

SEQ ID NO: 3330 - DNA, 13 bp, Artificial Sequence
  synthetic sequence
gccagaaagaaat

SEQ ID NO: 3331 - DNA, 13 bp, Artificial Sequence
  synthetic sequence
tagcttcaaacca

SEQ ID NO: 3332 - DNA, 13 bp, Artificial Sequence
  synthetic sequence
tagcctcgaacca

SEQ ID NO: 3333 - DNA, 13 bp, Artificial Sequence
  synthetic sequence
gcaccagtataag

SEQ ID NO: 3334 - DNA, 13 bp, Artificial Sequence
  synthetic sequence
tatactggcggcg

SEQ ID NO: 3335 - DNA, 13 bp, Artificial Sequence
  synthetic sequence
gtagctggctacc

SEQ ID NO: 3336 - DNA, 13 bp, Artificial Sequence
  synthetic sequence
aaagggcgagagg

SEQ ID NO: 3337 - DNA, 13 bp, Artificial Sequence
  synthetic sequence
cattctcaaacac

SEQ ID NO: 3338 - DNA, 13 bp, Artificial Sequence
  synthetic sequence
acggggagccgcc

SEQ ID NO: 3339 - DNA, 13 bp, Artificial Sequence
  synthetic sequence
ccccagttcttct

SEQ ID NO: 3340 - DNA, 13 bp, Artificial Sequence
  synthetic sequence
cagaagggattgg

SEQ ID NO: 3341 - DNA, 13 bp, Artificial Sequence
  synthetic sequence
ccgacctcagtgg

SEQ ID NO: 3342 - DNA, 13 bp, Artificial Sequence
  synthetic sequence
aagttgttgacaa

SEQ ID NO: 3343 - DNA, 13 bp, Artificial Sequence
  synthetic sequence
ggacggcggagcc

SEQ ID NO: 3344 - DNA, 13 bp, Artificial Sequence
  synthetic sequence
ggctcattccaaa

SEQ ID NO: 3345 - DNA, 13 bp, Artificial Sequence
  synthetic sequence
ccgtcgtgaatca

SEQ ID NO: 3346 - DNA, 13 bp, Artificial Sequence
  synthetic sequence
cgttctcaaagac

SEQ ID NO: 3347 - DNA, 13 bp, Artificial Sequence
  synthetic sequence
tgaacactagttt

SEQ ID NO: 3348 - DNA, 13 bp, Artificial Sequence
  synthetic sequence
ctcgctgcatatg

SEQ ID NO: 3349 - DNA, 13 bp, Artificial Sequence
  synthetic sequence
aaagggttagcag

SEQ ID NO: 3350 - DNA, 13 bp, Artificial Sequence
  synthetic sequence
ccaaaaatggacc

SEQ ID NO: 3351 - DNA, 13 bp, Artificial Sequence
  synthetic sequence
tcaagaagcccca

SEQ ID NO: 3352 - DNA, 13 bp, Artificial Sequence
  synthetic sequence
gcacctcaaggcc

SEQ ID NO: 3353 - DNA, 13 bp, Artificial Sequence
  synthetic sequence
gggtgagctcata

SEQ ID NO: 3354 - DNA, 13 bp, Artificial Sequence
  synthetic sequence
gaggccaaaaaga

SEQ ID NO: 3355 - DNA, 13 bp, Artificial Sequence
  synthetic sequence
cggcaattagcag

SEQ ID NO: 3356 - DNA, 13 bp, Artificial Sequence
  synthetic sequence
agaagggggcaca

SEQ ID NO: 3357 - DNA, 13 bp, Artificial Sequence
  synthetic sequence
aggtacctctgat

SEQ ID NO: 3358 - DNA, 13 bp, Artificial Sequence
  synthetic sequence
gggttatgttcca

SEQ ID NO: 3359 - DNA, 13 bp, Artificial Sequence
  synthetic sequence
gaaaaaggacgag

SEQ ID NO: 3360 - DNA, 13 bp, Artificial Sequence
  synthetic sequence
ggcactgactcat

SEQ ID NO: 3361 - DNA, 13 bp, Artificial Sequence
  synthetic sequence
gtatcaccctcat

SEQ ID NO: 3362 - DNA, 13 bp, Artificial Sequence
  synthetic sequence
ccaacttctggcc

SEQ ID NO: 3363 - DNA, 13 bp, Artificial Sequence
  synthetic sequence
aggcccggccgac

SEQ ID NO: 3364 - DNA, 13 bp, Artificial Sequence
  synthetic sequence
ccctctgcatatg

SEQ ID NO: 3365 - DNA, 13 bp, Artificial Sequence
  synthetic sequence
ccacaaaacgggt

SEQ ID NO: 3366 - DNA, 13 bp, Artificial Sequence
  synthetic sequence
ctatcacaggtgg

SEQ ID NO: 3367 - DNA, 13 bp, Artificial Sequence
  synthetic sequence
cagggggccgact

SEQ ID NO: 3368 - DNA, 13 bp, Artificial Sequence
  synthetic sequence
cctccagcccagc

SEQ ID NO: 3369 - DNA, 13 bp, Artificial Sequence
  synthetic sequence
gaagtgtatcagc

SEQ ID NO: 3370 - DNA, 13 bp, Artificial Sequence
  synthetic sequence
cctcgagctggcg

SEQ ID NO: 3371 - DNA, 13 bp, Artificial Sequence
  synthetic sequence
acatcacggctac

SEQ ID NO: 3372 - DNA, 13 bp, Artificial Sequence
  synthetic sequence
cacaaaatgggtt

SEQ ID NO: 3373 - DNA, 13 bp, Artificial Sequence
  synthetic sequence
catgaataatagg

SEQ ID NO: 3374 - DNA, 13 bp, Artificial Sequence
  synthetic sequence
tctcaccgcaaaa

SEQ ID NO: 3375 - DNA, 13 bp, Artificial Sequence
  synthetic sequence
gagtactgctgaa

SEQ ID NO: 3376 - DNA, 13 bp, Artificial Sequence
  synthetic sequence
cgctgatggcaaa

SEQ ID NO: 3377 - DNA, 13 bp, Artificial Sequence
  synthetic sequence
ggtgcgaggacac

SEQ ID NO: 3378 - DNA, 13 bp, Artificial Sequence
  synthetic sequence
tcatcaaagacaa

SEQ ID NO: 3379 - DNA, 13 bp, Artificial Sequence
  synthetic sequence
gtcggggtggtgg

SEQ ID NO: 3380 - DNA, 13 bp, Artificial Sequence
  synthetic sequence
aggcagatggaaa

SEQ ID NO: 3381 - DNA, 13 bp, Artificial Sequence
  synthetic sequence
cgctggtggcaaa

SEQ ID NO: 3382 - DNA, 13 bp, Artificial Sequence
  synthetic sequence
acaagttcatacg

SEQ ID NO: 3383 - DNA, 13 bp, Artificial Sequence
  synthetic sequence
taccacccgggcc

SEQ ID NO: 3384 - DNA, 13 bp, Artificial Sequence
  synthetic sequence
cctggtaaagagg

SEQ ID NO: 3385 - DNA, 13 bp, Artificial Sequence
  synthetic sequence
acacgacagccag

SEQ ID NO: 3386 - DNA, 13 bp, Artificial Sequence
  synthetic sequence
caaccgcagaaat

SEQ ID NO: 3387 - DNA, 13 bp, Artificial Sequence
  synthetic sequence
cataagtcacgac

SEQ ID NO: 3388 - DNA, 13 bp, Artificial Sequence
  synthetic sequence
ccccagaacaggg

SEQ ID NO: 3389 - DNA, 13 bp, Artificial Sequence
  synthetic sequence
ttggcctcgaacc

SEQ ID NO: 3390 - DNA, 13 bp, Artificial Sequence
  synthetic sequence
cggagcggcggca

SEQ ID NO: 3391 - DNA, 13 bp, Artificial Sequence
  synthetic sequence
gcagaacggcggc

SEQ ID NO: 3392 - DNA, 13 bp, Artificial Sequence
  synthetic sequence
cgacatcaggcac

SEQ ID NO: 3393 - DNA, 13 bp, Artificial Sequence
  synthetic sequence
tatactggcgacg

SEQ ID NO: 3394 - DNA, 13 bp, Artificial Sequence
  synthetic sequence
ttagcttcgaacc

SEQ ID NO: 3395 - DNA, 13 bp, Artificial Sequence
  synthetic sequence
gccatattccaaa

SEQ ID NO: 3396 - DNA, 13 bp, Artificial Sequence
  synthetic sequence
gacggggtaggcc

SEQ ID NO: 3397 - DNA, 13 bp, Artificial Sequence
  synthetic sequence
gtgtcaccctcat

SEQ ID NO: 3398 - DNA, 13 bp, Artificial Sequence
  synthetic sequence
cccaaaacaaaga

SEQ ID NO: 3399 - DNA, 13 bp, Artificial Sequence
  synthetic sequence
cattctcaaagac

SEQ ID NO: 3400 - DNA, 13 bp, Artificial Sequence
  synthetic sequence
tcaagcacagcta

SEQ ID NO: 3401 - DNA, 13 bp, Artificial Sequence
  synthetic sequence
gaaggggtgggac

SEQ ID NO: 3402 - DNA, 13 bp, Artificial Sequence
  synthetic sequence
gcacaagcacggc

SEQ ID NO: 3403 - DNA, 13 bp, Artificial Sequence
  synthetic sequence
ccctatagtcggg

SEQ ID NO: 3404 - DNA, 13 bp, Artificial Sequence
  synthetic sequence
cagggagcgcgga

SEQ ID NO: 3405 - DNA, 13 bp, Artificial Sequence
  synthetic sequence
ccagggccgaata

SEQ ID NO: 3406 - DNA, 13 bp, Artificial Sequence
  synthetic sequence
ttttcaaacacca

SEQ ID NO: 3407 - DNA, 13 bp, Artificial Sequence
  synthetic sequence
tccccctcgtatg

SEQ ID NO: 3408 - DNA, 13 bp, Artificial Sequence
  synthetic sequence
gtctgaggccaga

SEQ ID NO: 3409 - DNA, 13 bp, Artificial Sequence
  synthetic sequence
ccccagtataggg

SEQ ID NO: 3410 - DNA, 13 bp, Artificial Sequence
  synthetic sequence
cactgtccgatgt

SEQ ID NO: 3411 - DNA, 13 bp, Artificial Sequence
  synthetic sequence
cggcagttggcag

SEQ ID NO: 3412 - DNA, 13 bp, Artificial Sequence
  synthetic sequence
cgcgacggggctg

SEQ ID NO: 3413 - DNA, 13 bp, Artificial Sequence
  synthetic sequence
ggtggcagatggt

SEQ ID NO: 3414 - DNA, 13 bp, Artificial Sequence
  synthetic sequence
aatactgctggat

SEQ ID NO: 3415 - DNA, 13 bp, Artificial Sequence
  synthetic sequence
aatggattagccg

SEQ ID NO: 3416 - DNA, 13 bp, Artificial Sequence
  synthetic sequence
cccgcaggtgtca

SEQ ID NO: 3417 - DNA, 13 bp, Artificial Sequence
  synthetic sequence
ggatattaagcgc

SEQ ID NO: 3418 - DNA, 13 bp, Artificial Sequence
  synthetic sequence
tatgttcaacccg

SEQ ID NO: 3419 - DNA, 13 bp, Artificial Sequence
  synthetic sequence
agttgttaacaat

SEQ ID NO: 3420 - DNA, 13 bp, Artificial Sequence
  synthetic sequence
gcaagggccgagt

SEQ ID NO: 3421 - DNA, 13 bp, Artificial Sequence
  synthetic sequence
gcggttggagggc

SEQ ID NO: 3422 - DNA, 13 bp, Artificial Sequence
  synthetic sequence
cgcgagacatcac

SEQ ID NO: 3423 - DNA, 13 bp, Artificial Sequence
  synthetic sequence
agggggcaggtga

SEQ ID NO: 3424 - DNA, 13 bp, Artificial Sequence
  synthetic sequence
cagcaagattgaa

SEQ ID NO: 3425 - DNA, 13 bp, Artificial Sequence
  synthetic sequence
acaccaactgcag

SEQ ID NO: 3426 - DNA, 13 bp, Artificial Sequence
  synthetic sequence
cccagttcttttc

SEQ ID NO: 3427 - DNA, 13 bp, Artificial Sequence
  synthetic sequence
tgagaatgcaacg

SEQ ID NO: 3428 - DNA, 13 bp, Artificial Sequence
  synthetic sequence
cacggagggccga

SEQ ID NO: 3429 - DNA, 13 bp, Artificial Sequence
  synthetic sequence
ccggcgcaggcac

SEQ ID NO: 3430 - DNA, 13 bp, Artificial Sequence
  synthetic sequence
tcaaggagcccca

SEQ ID NO: 3431 - DNA, 13 bp, Artificial Sequence
  synthetic sequence
agtgccctataga

SEQ ID NO: 3432 - DNA, 13 bp, Artificial Sequence
  synthetic sequence
ccgcaaaacgggt

SEQ ID NO: 3433 - DNA, 13 bp, Artificial Sequence
  synthetic sequence
cattctcaaatac

SEQ ID NO: 3434 - DNA, 13 bp, Artificial Sequence
  synthetic sequence
caacagcacccac

SEQ ID NO: 3435 - DNA, 13 bp, Artificial Sequence
  synthetic sequence
ccaggaccaaata

SEQ ID NO: 3436 - DNA, 13 bp, Artificial Sequence
  synthetic sequence
cagtggactatat

SEQ ID NO: 3437 - DNA, 13 bp, Artificial Sequence
  synthetic sequence
cagaaaggattgg

SEQ ID NO: 3438 - DNA, 13 bp, Artificial Sequence
  synthetic sequence
ggcgcaatatagc

SEQ ID NO: 3439 - DNA, 13 bp, Artificial Sequence
  synthetic sequence
gaggccaaaagga

SEQ ID NO: 3440 - DNA, 13 bp, Artificial Sequence
  synthetic sequence
gagggcgagccgc

SEQ ID NO: 3441 - DNA, 13 bp, Artificial Sequence
  synthetic sequence
gacacatcacggt

SEQ ID NO: 3442 - DNA, 13 bp, Artificial Sequence
  synthetic sequence
cctcggtagcaga

SEQ ID NO: 3443 - DNA, 13 bp, Artificial Sequence
  synthetic sequence
gctccggcagcgg

SEQ ID NO: 3444 - DNA, 13 bp, Artificial Sequence
  synthetic sequence
cgttctcaaaaac

SEQ ID NO: 3445 - DNA, 13 bp, Artificial Sequence
  synthetic sequence
caggtggaagccc

SEQ ID NO: 3446 - DNA, 13 bp, Artificial Sequence
  synthetic sequence
gatgaaatcttaa

SEQ ID NO: 3447 - DNA, 13 bp, Artificial Sequence
  synthetic sequence
cctcaaaccaagc

SEQ ID NO: 3448 - DNA, 13 bp, Artificial Sequence
  synthetic sequence
tgagcacactatc

SEQ ID NO: 3449 - DNA, 13 bp, Artificial Sequence
  synthetic sequence
tcattttaagacg

SEQ ID NO: 3450 - DNA, 13 bp, Artificial Sequence
  synthetic sequence
aggcctgcagatg

SEQ ID NO: 3451 - DNA, 13 bp, Artificial Sequence
  synthetic sequence
acacggcagccag

SEQ ID NO: 3452 - DNA, 13 bp, Artificial Sequence
  synthetic sequence
caatggactatat

SEQ ID NO: 3453 - DNA, 13 bp, Artificial Sequence
  synthetic sequence
cgcaaaaggggtt

SEQ ID NO: 3454 - DNA, 13 bp, Artificial Sequence
  synthetic sequence
cacgatcgccatc

SEQ ID NO: 3455 - DNA, 13 bp, Artificial Sequence
  synthetic sequence
gagcgcgaaacgc

SEQ ID NO: 3456 - DNA, 13 bp, Artificial Sequence
  synthetic sequence
agttattgacaat

SEQ ID NO: 3457 - DNA, 13 bp, Artificial Sequence
  synthetic sequence
acaccaacagcag

SEQ ID NO: 3458 - DNA, 13 bp, Artificial Sequence
  synthetic sequence
acaagcttctggc

SEQ ID NO: 3459 - DNA, 13 bp, Artificial Sequence
  synthetic sequence
gcatgaatgatcg

SEQ ID NO: 3460 - DNA, 13 bp, Artificial Sequence
  synthetic sequence
aaacagcaaccgc

SEQ ID NO: 3461 - DNA, 13 bp, Artificial Sequence
  synthetic sequence
agtgttattccct

SEQ ID NO: 3462 - DNA, 13 bp, Artificial Sequence
  synthetic sequence
tcacaccaccaag

SEQ ID NO: 3463 - DNA, 13 bp, Artificial Sequence
  synthetic sequence
catctgggacagg

SEQ ID NO: 3464 - DNA, 13 bp, Artificial Sequence
  synthetic sequence
ataactagacatc

SEQ ID NO: 3465 - DNA, 13 bp, Artificial Sequence
  synthetic sequence
tccaattgggcct

SEQ ID NO: 3466 - DNA, 13 bp, Artificial Sequence
  synthetic sequence
cggaggacagaaa

SEQ ID NO: 3467 - DNA, 13 bp, Artificial Sequence
  synthetic sequence
tgcttggtagagg

SEQ ID NO: 3468 - DNA, 13 bp, Artificial Sequence
  synthetic sequence
cagaggtcaagct

SEQ ID NO: 3469 - DNA, 13 bp, Artificial Sequence
  synthetic sequence
ggcgaaggcgtcg

SEQ ID NO: 3470 - DNA, 13 bp, Artificial Sequence
  synthetic sequence
tatagtcaggagc

SEQ ID NO: 3471 - DNA, 13 bp, Artificial Sequence
  synthetic sequence
ctcgaataccatg

SEQ ID NO: 3472 - DNA, 13 bp, Artificial Sequence
  synthetic sequence
gcaggtggggcgg

SEQ ID NO: 3473 - DNA, 13 bp, Artificial Sequence
  synthetic sequence
ggtcgacaggggg

SEQ ID NO: 3474 - DNA, 13 bp, Artificial Sequence
  synthetic sequence
tggtgacaaatgg

SEQ ID NO: 3475 - DNA, 13 bp, Artificial Sequence
  synthetic sequence
gacatactcatgg

SEQ ID NO: 3476 - DNA, 13 bp, Artificial Sequence
  synthetic sequence
aattgttgacaat

SEQ ID NO: 3477 - DNA, 13 bp, Artificial Sequence
  synthetic sequence
ccacagaaagggt

SEQ ID NO: 3478 - DNA, 13 bp, Artificial Sequence
  synthetic sequence
gatggtatgccaa

SEQ ID NO: 3479 - DNA, 13 bp, Artificial Sequence
  synthetic sequence
aggatttcataaa

SEQ ID NO: 3480 - DNA, 13 bp, Artificial Sequence
  synthetic sequence
ccccggtataggg

SEQ ID NO: 3481 - DNA, 13 bp, Artificial Sequence
  synthetic sequence
cacaaaaggggtt

SEQ ID NO: 3482 - DNA, 13 bp, Artificial Sequence
  synthetic sequence
aggccaccaagca

SEQ ID NO: 3483 - DNA, 13 bp, Artificial Sequence
  synthetic sequence
gctgatggaaaca

SEQ ID NO: 3484 - DNA, 13 bp, Artificial Sequence
  synthetic sequence
gtgttagtataag

SEQ ID NO: 3485 - DNA, 13 bp, Artificial Sequence
  synthetic sequence
gctcgttccaaaa

SEQ ID NO: 3486 - DNA, 13 bp, Artificial Sequence
  synthetic sequence
tcgagctcaagca

SEQ ID NO: 3487 - DNA, 13 bp, Artificial Sequence
  synthetic sequence
gcggagcggcgac

SEQ ID NO: 3488 - DNA, 13 bp, Artificial Sequence
  synthetic sequence
gctgatggcagat

SEQ ID NO: 3489 - DNA, 13 bp, Artificial Sequence
  synthetic sequence
gaaggggtgggcc

SEQ ID NO: 3490 - DNA, 13 bp, Artificial Sequence
  synthetic sequence
tagagtgctgctg

SEQ ID NO: 3491 - DNA, 13 bp, Artificial Sequence
  synthetic sequence
actgaatctcggc

SEQ ID NO: 3492 - DNA, 13 bp, Artificial Sequence
  synthetic sequence
gatcaagcaaccc

SEQ ID NO: 3493 - DNA, 13 bp, Artificial Sequence
  synthetic sequence
gccagaaggagat

SEQ ID NO: 3494 - DNA, 13 bp, Artificial Sequence
  synthetic sequence
ggtggtccaattg

SEQ ID NO: 3495 - DNA, 13 bp, Artificial Sequence
  synthetic sequence
cccttcagcctcc

SEQ ID NO: 3496 - DNA, 13 bp, Artificial Sequence
  synthetic sequence
cacgccaaaaccc

SEQ ID NO: 3497 - DNA, 13 bp, Artificial Sequence
  synthetic sequence
gagagtcgtaatc

SEQ ID NO: 3498 - DNA, 13 bp, Artificial Sequence
  synthetic sequence
tcatcaaatacaa

SEQ ID NO: 3499 - DNA, 13 bp, Artificial Sequence
  synthetic sequence
tgcataggctgca

SEQ ID NO: 3500 - DNA, 13 bp, Artificial Sequence
  synthetic sequence
cctcagtagcgga

SEQ ID NO: 3501 - DNA, 13 bp, Artificial Sequence
  synthetic sequence
catcgaaaacaag

SEQ ID NO: 3502 - DNA, 13 bp, Artificial Sequence
  synthetic sequence
caaaggtcaagct

SEQ ID NO: 3503 - DNA, 13 bp, Artificial Sequence
  synthetic sequence
tttggggccaaaa

SEQ ID NO: 3504 - DNA, 13 bp, Artificial Sequence
  synthetic sequence
tggcttcaaacca

SEQ ID NO: 3505 - DNA, 13 bp, Artificial Sequence
  synthetic sequence
ggtacgcctgccg

SEQ ID NO: 3506 - DNA, 13 bp, Artificial Sequence
  synthetic sequence
gtgaacactaatt

SEQ ID NO: 3507 - DNA, 13 bp, Artificial Sequence
  synthetic sequence
agaatgcaacggc

SEQ ID NO: 3508 - DNA, 13 bp, Artificial Sequence
  synthetic sequence
cctccccaccagc

SEQ ID NO: 3509 - DNA, 13 bp, Artificial Sequence
  synthetic sequence
aatactgctgaat

SEQ ID NO: 3510 - DNA, 13 bp, Artificial Sequence
  synthetic sequence
cgatagccggttc

SEQ ID NO: 3511 - DNA, 13 bp, Artificial Sequence
  synthetic sequence
gggacacatcacg

SEQ ID NO: 3512 - DNA, 13 bp, Artificial Sequence
  synthetic sequence
caggagtgagctc

SEQ ID NO: 3513 - DNA, 13 bp, Artificial Sequence
  synthetic sequence
aaggggtattagt

SEQ ID NO: 3514 - DNA, 13 bp, Artificial Sequence
  synthetic sequence
ccacaaaaagggt

SEQ ID NO: 3515 - DNA, 13 bp, Artificial Sequence
  synthetic sequence
gcagtgatcacag

SEQ ID NO: 3516 - DNA, 13 bp, Artificial Sequence
  synthetic sequence
accatactggagc

SEQ ID NO: 3517 - DNA, 13 bp, Artificial Sequence
  synthetic sequence
ggctcagtcaggt

SEQ ID NO: 3518 - DNA, 13 bp, Artificial Sequence
  synthetic sequence
tgcggaacgttga

SEQ ID NO: 3519 - DNA, 13 bp, Artificial Sequence
  synthetic sequence
gccggcacaagcg

SEQ ID NO: 3520 - DNA, 13 bp, Artificial Sequence
  synthetic sequence
ccatgttccacac

SEQ ID NO: 3521 - DNA, 13 bp, Artificial Sequence
  synthetic sequence
catcgcggctgca

SEQ ID NO: 3522 - DNA, 13 bp, Artificial Sequence
  synthetic sequence
tagtacagccggc

SEQ ID NO: 3523 - DNA, 13 bp, Artificial Sequence
  synthetic sequence
acacatcacgact

SEQ ID NO: 3524 - DNA, 13 bp, Artificial Sequence
  synthetic sequence
ccgactgcagaaa

SEQ ID NO: 3525 - DNA, 13 bp, Artificial Sequence
  synthetic sequence
agttattgactat

SEQ ID NO: 3526 - DNA, 13 bp, Artificial Sequence
  synthetic sequence
ccccaattctttt

SEQ ID NO: 3527 - DNA, 13 bp, Artificial Sequence
  synthetic sequence
gggacccgcctgc

SEQ ID NO: 3528 - DNA, 13 bp, Artificial Sequence
  synthetic sequence
ccaaagatggacc

SEQ ID NO: 3529 - DNA, 13 bp, Artificial Sequence
  synthetic sequence
ctcgtcaaagaca

SEQ ID NO: 3530 - DNA, 13 bp, Artificial Sequence
  synthetic sequence
gaagaaccgagaa

SEQ ID NO: 3531 - DNA, 13 bp, Artificial Sequence
  synthetic sequence
tcagtggcggagt

SEQ ID NO: 3532 - DNA, 13 bp, Artificial Sequence
  synthetic sequence
ttagcagactccc

SEQ ID NO: 3533 - DNA, 13 bp, Artificial Sequence
  synthetic sequence
cacacgcacggcc

SEQ ID NO: 3534 - DNA, 13 bp, Artificial Sequence
  synthetic sequence
gagcctcaagctg

SEQ ID NO: 3535 - DNA, 13 bp, Artificial Sequence
  synthetic sequence
aacactagcttct

SEQ ID NO: 3536 - DNA, 13 bp, Artificial Sequence
  synthetic sequence
gcaagaacaccaa

SEQ ID NO: 3537 - DNA, 13 bp, Artificial Sequence
  synthetic sequence
gtatcgccctcgt

SEQ ID NO: 3538 - DNA, 13 bp, Artificial Sequence
  synthetic sequence
ttcctatctgtaa

SEQ ID NO: 3539 - DNA, 13 bp, Artificial Sequence
  synthetic sequence
ctataatcggggg

SEQ ID NO: 3540 - DNA, 13 bp, Artificial Sequence
  synthetic sequence
tgatgacaaatgg

SEQ ID NO: 3541 - DNA, 13 bp, Artificial Sequence
  synthetic sequence
ccgtcgtggatca

SEQ ID NO: 3542 - DNA, 13 bp, Artificial Sequence
  synthetic sequence
agaatactgttgg

SEQ ID NO: 3543 - DNA, 13 bp, Artificial Sequence
  synthetic sequence
tcttcccctccaa

SEQ ID NO: 3544 - DNA, 13 bp, Artificial Sequence
  synthetic sequence
gaggttgggaata

SEQ ID NO: 3545 - DNA, 13 bp, Artificial Sequence
  synthetic sequence
tggcatattgtca

SEQ ID NO: 3546 - DNA, 13 bp, Artificial Sequence
  synthetic sequence
ttccaaaatagag

SEQ ID NO: 3547 - DNA, 13 bp, Artificial Sequence
  synthetic sequence
gggccgatagctc

SEQ ID NO: 3548 - DNA, 13 bp, Artificial Sequence
  synthetic sequence
ctcgaaaaccttg

SEQ ID NO: 3549 - DNA, 13 bp, Artificial Sequence
  synthetic sequence
tcccgggtcttac

SEQ ID NO: 3550 - DNA, 13 bp, Artificial Sequence
  synthetic sequence
agaaggggttagc

SEQ ID NO: 3551 - DNA, 13 bp, Artificial Sequence
  synthetic sequence
ccccagaacagag

SEQ ID NO: 3552 - DNA, 13 bp, Artificial Sequence
  synthetic sequence
tagacactgtcgg

SEQ ID NO: 3553 - DNA, 13 bp, Artificial Sequence
  synthetic sequence
gaatccaacgctg

SEQ ID NO: 3554 - DNA, 13 bp, Artificial Sequence
  synthetic sequence
cacgctgcatgtg

SEQ ID NO: 3555 - DNA, 13 bp, Artificial Sequence
  synthetic sequence
caatctggccgcc

SEQ ID NO: 3556 - DNA, 13 bp, Artificial Sequence
  synthetic sequence
gctggcgcccatg

SEQ ID NO: 3557 - DNA, 13 bp, Artificial Sequence
  synthetic sequence
gccagaatgacat

SEQ ID NO: 3558 - DNA, 13 bp, Artificial Sequence
  synthetic sequence
cctgcaagccggc

SEQ ID NO: 3559 - DNA, 13 bp, Artificial Sequence
  synthetic sequence
gcccgttgcatat

SEQ ID NO: 3560 - DNA, 13 bp, Artificial Sequence
  synthetic sequence
caaagaaggtctt

SEQ ID NO: 3561 - DNA, 13 bp, Artificial Sequence
  synthetic sequence
agtgcactatatc

SEQ ID NO: 3562 - DNA, 13 bp, Artificial Sequence
  synthetic sequence
aaaaggggcgaga

SEQ ID NO: 3563 - DNA, 13 bp, Artificial Sequence
  synthetic sequence
agatggagatggc

SEQ ID NO: 3564 - DNA, 13 bp, Artificial Sequence
  synthetic sequence
gaaaaagggcgag

SEQ ID NO: 3565 - DNA, 13 bp, Artificial Sequence
  synthetic sequence
acactatcagaca

SEQ ID NO: 3566 - DNA, 13 bp, Artificial Sequence
  synthetic sequence
gctggatggtagt

SEQ ID NO: 3567 - DNA, 13 bp, Artificial Sequence
  synthetic sequence
ttggggccgacag

SEQ ID NO: 3568 - DNA, 13 bp, Artificial Sequence
  synthetic sequence
catcggggacagg

SEQ ID NO: 3569 - DNA, 13 bp, Artificial Sequence
  synthetic sequence
tgcgggatgttaa

SEQ ID NO: 3570 - DNA, 13 bp, Artificial Sequence
  synthetic sequence
gtgttggtgtagg

SEQ ID NO: 3571 - DNA, 13 bp, Artificial Sequence
  synthetic sequence
agcagatggggtg

SEQ ID NO: 3572 - DNA, 13 bp, Artificial Sequence
  synthetic sequence
cgccggggccaaa

SEQ ID NO: 3573 - DNA, 13 bp, Artificial Sequence
  synthetic sequence
gaccgccggcaat

SEQ ID NO: 3574 - DNA, 13 bp, Artificial Sequence
  synthetic sequence
agaatgttattcc

SEQ ID NO: 3575 - DNA, 13 bp, Artificial Sequence
  synthetic sequence
acctcatcacgcc

SEQ ID NO: 3576 - DNA, 13 bp, Artificial Sequence
  synthetic sequence
cgccaaccgcaga

SEQ ID NO: 3577 - DNA, 13 bp, Artificial Sequence
  synthetic sequence
atctggtaccgtg

SEQ ID NO: 3578 - DNA, 13 bp, Artificial Sequence
  synthetic sequence
tgtaactaagact

SEQ ID NO: 3579 - DNA, 13 bp, Artificial Sequence
  synthetic sequence
caaaatcaaccat

SEQ ID NO: 3580 - DNA, 13 bp, Artificial Sequence
  synthetic sequence
tctcaaacaccat

SEQ ID NO: 3581 - DNA, 13 bp, Artificial Sequence
  synthetic sequence
gcagtgcacagac

SEQ ID NO: 3582 - DNA, 13 bp, Artificial Sequence
  synthetic sequence
cgtcaaaaacgag

SEQ ID NO: 3583 - DNA, 13 bp, Artificial Sequence
  synthetic sequence
cattttcaaaaac

SEQ ID NO: 3584 - DNA, 13 bp, Artificial Sequence
  synthetic sequence
ggggccacagcat

SEQ ID NO: 3585 - DNA, 13 bp, Artificial Sequence
  synthetic sequence
cgcgagacgtcgc

SEQ ID NO: 3586 - DNA, 13 bp, Artificial Sequence
  synthetic sequence
aaccggcacaagc

SEQ ID NO: 3587 - DNA, 13 bp, Artificial Sequence
  synthetic sequence
cccaattcttctc

SEQ ID NO: 3588 - DNA, 13 bp, Artificial Sequence
  synthetic sequence
cataggggcaatt

SEQ ID NO: 3589 - DNA, 13 bp, Artificial Sequence
  synthetic sequence
tcatcaaacacaa

SEQ ID NO: 3590 - DNA, 13 bp, Artificial Sequence
  synthetic sequence
aatcactgcacgg

SEQ ID NO: 3591 - DNA, 13 bp, Artificial Sequence
  synthetic sequence
acaagctgcattt

SEQ ID NO: 3592 - DNA, 13 bp, Artificial Sequence
  synthetic sequence
cccaaaacagaga

SEQ ID NO: 3593 - DNA, 13 bp, Artificial Sequence
  synthetic sequence
cgagggcaccggt

SEQ ID NO: 3594 - DNA, 13 bp, Artificial Sequence
  synthetic sequence
gctcgctgcatgt

SEQ ID NO: 3595 - DNA, 13 bp, Artificial Sequence
  synthetic sequence
catgagcaacaat

SEQ ID NO: 3596 - DNA, 13 bp, Artificial Sequence
  synthetic sequence
tgttatttgttca

SEQ ID NO: 3597 - DNA, 13 bp, Artificial Sequence
  synthetic sequence
tgaactatatccg

SEQ ID NO: 3598 - DNA, 13 bp, Artificial Sequence
  synthetic sequence
acaaggccggaat

SEQ ID NO: 3599 - DNA, 13 bp, Artificial Sequence
  synthetic sequence
ccatcatgaatca

SEQ ID NO: 3600 - DNA, 13 bp, Artificial Sequence
  synthetic sequence
agtcaggggcaac

SEQ ID NO: 3601 - DNA, 13 bp, Artificial Sequence
  synthetic sequence
acccacagcagaa

SEQ ID NO: 3602 - DNA, 13 bp, Artificial Sequence
  synthetic sequence
tataactaagact

SEQ ID NO: 3603 - DNA, 13 bp, Artificial Sequence
  synthetic sequence
ctctggtggcaaa

SEQ ID NO: 3604 - DNA, 13 bp, Artificial Sequence
  synthetic sequence
ctgacgggaagag

SEQ ID NO: 3605 - DNA, 13 bp, Artificial Sequence
  synthetic sequence
taaaaattgtgca

SEQ ID NO: 3606 - DNA, 13 bp, Artificial Sequence
  synthetic sequence
acatcagggacag

SEQ ID NO: 3607 - DNA, 13 bp, Artificial Sequence
  synthetic sequence
ggcataactaaga

SEQ ID NO: 3608 - DNA, 13 bp, Artificial Sequence
  synthetic sequence
ccgacctcggtgg

SEQ ID NO: 3609 - DNA, 13 bp, Artificial Sequence
  synthetic sequence
ttggtccgttggg

SEQ ID NO: 3610 - DNA, 13 bp, Artificial Sequence
  synthetic sequence
agcggctggaggg

SEQ ID NO: 3611 - DNA, 13 bp, Artificial Sequence
  synthetic sequence
gcacgaagaactg

SEQ ID NO: 3612 - DNA, 13 bp, Artificial Sequence
  synthetic sequence
ccgtcatgaatca

SEQ ID NO: 3613 - DNA, 13 bp, Artificial Sequence
  synthetic sequence
acaaacttgccaa

SEQ ID NO: 3614 - DNA, 13 bp, Artificial Sequence
  synthetic sequence
acggcatgtatta

SEQ ID NO: 3615 - DNA, 13 bp, Artificial Sequence
  synthetic sequence
gtgcgagagcgtc

SEQ ID NO: 3616 - DNA, 13 bp, Artificial Sequence
  synthetic sequence
aacagatggcagg

SEQ ID NO: 3617 - DNA, 13 bp, Artificial Sequence
  synthetic sequence
atcactctttggc

SEQ ID NO: 3618 - DNA, 13 bp, Artificial Sequence
  synthetic sequence
tgatgacagcatg

SEQ ID NO: 3619 - DNA, 13 bp, Artificial Sequence
  synthetic sequence
tcaacataattgg

SEQ ID NO: 3620 - DNA, 13 bp, Artificial Sequence
  synthetic sequence
ctgaaaatccata

SEQ ID NO: 3621 - DNA, 13 bp, Artificial Sequence
  synthetic sequence
gtacaaatggcag

SEQ ID NO: 3622 - DNA, 13 bp, Artificial Sequence
  synthetic sequence
tggacatatcaaa

SEQ ID NO: 3623 - DNA, 13 bp, Artificial Sequence
  synthetic sequence
gtctccatagaat

SEQ ID NO: 3624 - DNA, 13 bp, Artificial Sequence
  synthetic sequence
tagtaacagactc

SEQ ID NO: 3625 - DNA, 13 bp, Artificial Sequence
  synthetic sequence
atcaacagctcct

SEQ ID NO: 3626 - DNA, 13 bp, Artificial Sequence
  synthetic sequence
tatgtaggatctg

SEQ ID NO: 3627 - DNA, 13 bp, Artificial Sequence
  synthetic sequence
atgcaaatgttaa

SEQ ID NO: 3628 - DNA, 13 bp, Artificial Sequence
  synthetic sequence
tggagagcaatgg

SEQ ID NO: 3629 - DNA, 13 bp, Artificial Sequence
  synthetic sequence
cagcagaaacagg

SEQ ID NO: 3630 - DNA, 13 bp, Artificial Sequence
  synthetic sequence
tttaacatgtgga

SEQ ID NO: 3631 - DNA, 13 bp, Artificial Sequence
  synthetic sequence
attgggcaagtca

SEQ ID NO: 3632 - DNA, 13 bp, Artificial Sequence
  synthetic sequence
aaattatggtacc

SEQ ID NO: 3633 - DNA, 13 bp, Artificial Sequence
  synthetic sequence
tggggatacttgg

SEQ ID NO: 3634 - DNA, 13 bp, Artificial Sequence
  synthetic sequence
aatgagacaccag

SEQ ID NO: 3635 - DNA, 13 bp, Artificial Sequence
  synthetic sequence
tatggggtacctg

SEQ ID NO: 3636 - DNA, 13 bp, Artificial Sequence
  synthetic sequence
ctctcgacgcagg

SEQ ID NO: 3637 - DNA, 13 bp, Artificial Sequence
  synthetic sequence
aattaccctatag

SEQ ID NO: 3638 - DNA, 13 bp, Artificial Sequence
  synthetic sequence
gacctggaggagg

SEQ ID NO: 3639 - DNA, 13 bp, Artificial Sequence
  synthetic sequence
caggatcagaaga

SEQ ID NO: 3640 - DNA, 13 bp, Artificial Sequence
  synthetic sequence
taaacatgtggca

SEQ ID NO: 3641 - DNA, 13 bp, Artificial Sequence
  synthetic sequence
attctaaagtgta

SEQ ID NO: 3642 - DNA, 13 bp, Artificial Sequence
  synthetic sequence
aagcacattgtaa

SEQ ID NO: 3643 - DNA, 13 bp, Artificial Sequence
  synthetic sequence
gaaaagaatgaac

SEQ ID NO: 3644 - DNA, 13 bp, Artificial Sequence
  synthetic sequence
tcaaagcagtaag

SEQ ID NO: 3645 - DNA, 13 bp, Artificial Sequence
  synthetic sequence
ccacctttgccta

SEQ ID NO: 3646 - DNA, 13 bp, Artificial Sequence
  synthetic sequence
ttaattgtggagg

SEQ ID NO: 3647 - DNA, 13 bp, Artificial Sequence
  synthetic sequence
actcacctttgtc

SEQ ID NO: 3648 - DNA, 13 bp, Artificial Sequence
  synthetic sequence
ggaacttctggga

SEQ ID NO: 3649 - DNA, 13 bp, Artificial Sequence
  synthetic sequence
ccacctctgccta

SEQ ID NO: 3650 - DNA, 13 bp, Artificial Sequence
  synthetic sequence
aaaccataatagt

SEQ ID NO: 3651 - DNA, 13 bp, Artificial Sequence
  synthetic sequence
tgctattgtaaaa

SEQ ID NO: 3652 - DNA, 13 bp, Artificial Sequence
  synthetic sequence
ccaaagcagtaag

SEQ ID NO: 3653 - DNA, 13 bp, Artificial Sequence
  synthetic sequence
aattatcctatag

SEQ ID NO: 3654 - DNA, 13 bp, Artificial Sequence
  synthetic sequence
agacaggaacaga

SEQ ID NO: 3655 - DNA, 13 bp, Artificial Sequence
  synthetic sequence
gaatttttctatt

SEQ ID NO: 3656 - DNA, 13 bp, Artificial Sequence
  synthetic sequence
gaaacagcatact

SEQ ID NO: 3657 - DNA, 13 bp, Artificial Sequence
  synthetic sequence
accatacctagta

SEQ ID NO: 3658 - DNA, 13 bp, Artificial Sequence
  synthetic sequence
aatagacaggtta

SEQ ID NO: 3659 - DNA, 13 bp, Artificial Sequence
  synthetic sequence
gctggttttgcga

SEQ ID NO: 3660 - DNA, 13 bp, Artificial Sequence
  synthetic sequence
taaactgggcaag

SEQ ID NO: 3661 - DNA, 13 bp, Artificial Sequence
  synthetic sequence
tgttggaaatgtg

SEQ ID NO: 3662 - DNA, 13 bp, Artificial Sequence
  synthetic sequence
tttgtcaataccc

SEQ ID NO: 3663 - DNA, 13 bp, Artificial Sequence
  synthetic sequence
cgagagcgtcagt

SEQ ID NO: 3664 - DNA, 13 bp, Artificial Sequence
  synthetic sequence
tttcgggtttatt

SEQ ID NO: 3665 - DNA, 13 bp, Artificial Sequence
  synthetic sequence
gaagcactatggg

SEQ ID NO: 3666 - DNA, 13 bp, Artificial Sequence
  synthetic sequence
taaatatgtggca

SEQ ID NO: 3667 - DNA, 13 bp, Artificial Sequence
  synthetic sequence
taggagatataag

SEQ ID NO: 3668 - DNA, 13 bp, Artificial Sequence
  synthetic sequence
taatagtacagct

SEQ ID NO: 3669 - DNA, 13 bp, Artificial Sequence
  synthetic sequence
tgttactgtaaaa

SEQ ID NO: 3670 - DNA, 13 bp, Artificial Sequence
  synthetic sequence
ggaggagatatga

SEQ ID NO: 3671 - DNA, 13 bp, Artificial Sequence
  synthetic sequence
gaaagatacctaa

SEQ ID NO: 3672 - DNA, 13 bp, Artificial Sequence
  synthetic sequence
tgtgggtcacagt

SEQ ID NO: 3673 - DNA, 13 bp, Artificial Sequence
  synthetic sequence
ccagctggttatg

SEQ ID NO: 3674 - DNA, 13 bp, Artificial Sequence
  synthetic sequence
gtcagcctaaaac

SEQ ID NO: 3675 - DNA, 13 bp, Artificial Sequence
  synthetic sequence
tagtaacagattc

SEQ ID NO: 3676 - DNA, 13 bp, Artificial Sequence
  synthetic sequence
atatctatgaaac

SEQ ID NO: 3677 - DNA, 13 bp, Artificial Sequence
  synthetic sequence
cacagcaattgga

SEQ ID NO: 3678 - DNA, 13 bp, Artificial Sequence
  synthetic sequence
ttaagacagcagt

SEQ ID NO: 3679 - DNA, 13 bp, Artificial Sequence
  synthetic sequence
aaaacaataatag

SEQ ID NO: 3680 - DNA, 13 bp, Artificial Sequence
  synthetic sequence
ttgtaacacctca

SEQ ID NO: 3681 - DNA, 13 bp, Artificial Sequence
  synthetic sequence
tagaaatagggca

SEQ ID NO: 3682 - DNA, 13 bp, Artificial Sequence
  synthetic sequence
caggagaaagaga

SEQ ID NO: 3683 - DNA, 13 bp, Artificial Sequence
  synthetic sequence
ttgaagaatcgca

SEQ ID NO: 3684 - DNA, 13 bp, Artificial Sequence
  synthetic sequence
aaaataacatggt

SEQ ID NO: 3685 - DNA, 13 bp, Artificial Sequence
  synthetic sequence
tgtgggttacagt

SEQ ID NO: 3686 - DNA, 13 bp, Artificial Sequence
  synthetic sequence
tgcagatgttaaa

SEQ ID NO: 3687 - DNA, 13 bp, Artificial Sequence
  synthetic sequence
taggctttccagt

SEQ ID NO: 3688 - DNA, 13 bp, Artificial Sequence
  synthetic sequence
gagccagcagcag

SEQ ID NO: 3689 - DNA, 13 bp, Artificial Sequence
  synthetic sequence
aatctgaaaacag

SEQ ID NO: 3690 - DNA, 13 bp, Artificial Sequence
  synthetic sequence
caaaaccagcagg

SEQ ID NO: 3691 - DNA, 13 bp, Artificial Sequence
  synthetic sequence
tatttgccataaa

SEQ ID NO: 3692 - DNA, 13 bp, Artificial Sequence
  synthetic sequence
ccagagcagtaag

SEQ ID NO: 3693 - DNA, 13 bp, Artificial Sequence
  synthetic sequence
ggaggaaatatga

SEQ ID NO: 3694 - DNA, 13 bp, Artificial Sequence
  synthetic sequence
tgttattgtaaaa

SEQ ID NO: 3695 - DNA, 13 bp, Artificial Sequence
  synthetic sequence
taagaatgtatag

SEQ ID NO: 3696 - DNA, 13 bp, Artificial Sequence
  synthetic sequence
cagaaccagcagg

SEQ ID NO: 3697 - DNA, 13 bp, Artificial Sequence
  synthetic sequence
aatttttctactg

SEQ ID NO: 3698 - DNA, 13 bp, Artificial Sequence
  synthetic sequence
aaagaaaaataga

SEQ ID NO: 3699 - DNA, 13 bp, Artificial Sequence
  synthetic sequence
tgcaaatgctaaa

SEQ ID NO: 3700 - DNA, 13 bp, Artificial Sequence
  synthetic sequence
tcacaaacaatgc

SEQ ID NO: 3701 - DNA, 13 bp, Artificial Sequence
  synthetic sequence
taataggagacat

SEQ ID NO: 3702 - DNA, 13 bp, Artificial Sequence
  synthetic sequence
taggacctacacc

SEQ ID NO: 3703 - DNA, 13 bp, Artificial Sequence
  synthetic sequence
tcgtttcagaccc

SEQ ID NO: 3704 - DNA, 13 bp, Artificial Sequence
  synthetic sequence
cttaaatcattat

SEQ ID NO: 3705 - DNA, 13 bp, Artificial Sequence
  synthetic sequence
ccaaagcagtgag

SEQ ID NO: 3706 - DNA, 13 bp, Artificial Sequence
  synthetic sequence
ggagtaggagcag

SEQ ID NO: 3707 - DNA, 13 bp, Artificial Sequence
  synthetic sequence
cagatgcatgagg

SEQ ID NO: 3708 - DNA, 13 bp, Artificial Sequence
  synthetic sequence
atataagacaagc

SEQ ID NO: 3709 - DNA, 13 bp, Artificial Sequence
  synthetic sequence
tggagatacttgg

SEQ ID NO: 3710 - DNA, 13 bp, Artificial Sequence
  synthetic sequence
attgggcaagcca

SEQ ID NO: 3711 - DNA, 13 bp, Artificial Sequence
  synthetic sequence
ttgtaatacctca

SEQ ID NO: 3712 - DNA, 13 bp, Artificial Sequence
  synthetic sequence
gtcagccaaaatt

SEQ ID NO: 3713 - DNA, 13 bp, Artificial Sequence
  synthetic sequence
cacagtaattgga

SEQ ID NO: 3714 - DNA, 13 bp, Artificial Sequence
  synthetic sequence
aaaggaaaataga

SEQ ID NO: 3715 - DNA, 13 bp, Artificial Sequence
  synthetic sequence
aatgaaacaccag

SEQ ID NO: 3716 - DNA, 13 bp, Artificial Sequence
  synthetic sequence
aaattatggtatc

SEQ ID NO: 3717 - DNA, 13 bp, Artificial Sequence
  synthetic sequence
gtaggacaagcaa

SEQ ID NO: 3718 - DNA, 13 bp, Artificial Sequence
  synthetic sequence
tagaagaaatgat

SEQ ID NO: 3719 - DNA, 13 bp, Artificial Sequence
  synthetic sequence
cactaacagcatt

SEQ ID NO: 3720 - DNA, 13 bp, Artificial Sequence
  synthetic sequence
aaaaacataatag

SEQ ID NO: 3721 - DNA, 13 bp, Artificial Sequence
  synthetic sequence
gcgtcaatattaa

SEQ ID NO: 3722 - DNA, 13 bp, Artificial Sequence
  synthetic sequence
gagggaacccgac

SEQ ID NO: 3723 - DNA, 13 bp, Artificial Sequence
  synthetic sequence
tgctattgtaaac

SEQ ID NO: 3724 - DNA, 13 bp, Artificial Sequence
  synthetic sequence
aatctaaaaacag

SEQ ID NO: 3725 - DNA, 13 bp, Artificial Sequence
  synthetic sequence
tatgcattaggaa

SEQ ID NO: 3726 - DNA, 13 bp, Artificial Sequence
  synthetic sequence
aggactcggcttg

SEQ ID NO: 3727 - DNA, 13 bp, Artificial Sequence
  synthetic sequence
cttagatcattat

SEQ ID NO: 3728 - DNA, 13 bp, Artificial Sequence
  synthetic sequence
gagaccttcagac

SEQ ID NO: 3729 - DNA, 13 bp, Artificial Sequence
  synthetic sequence
tagtgcaaaatgc

SEQ ID NO: 3730 - DNA, 13 bp, Artificial Sequence
  synthetic sequence
gtcagcctacaac

SEQ ID NO: 3731 - DNA, 13 bp, Artificial Sequence
  synthetic sequence
tgggacgcagcag

SEQ ID NO: 3732 - DNA, 13 bp, Artificial Sequence
  synthetic sequence
tatttgctataaa

SEQ ID NO: 3733 - DNA, 13 bp, Artificial Sequence
  synthetic sequence
cagcagagacagg

SEQ ID NO: 3734 - DNA, 13 bp, Artificial Sequence
  synthetic sequence
tcatttcagaccc

SEQ ID NO: 3735 - DNA, 13 bp, Artificial Sequence
  synthetic sequence
ccagctggttttg

SEQ ID NO: 3736 - DNA, 13 bp, Artificial Sequence
  synthetic sequence
taataaattgcaa

SEQ ID NO: 3737 - DNA, 13 bp, Artificial Sequence
  synthetic sequence
tttccagtcagac

SEQ ID NO: 3738 - DNA, 13 bp, Artificial Sequence
  synthetic sequence
atgatttgtatgt

SEQ ID NO: 3739 - DNA, 13 bp, Artificial Sequence
  synthetic sequence
gcactgaaagcat

SEQ ID NO: 3740 - DNA, 13 bp, Artificial Sequence
  synthetic sequence
tcaaagcagtgag

SEQ ID NO: 3741 - DNA, 13 bp, Artificial Sequence
  synthetic sequence
ccatcagccccac

SEQ ID NO: 3742 - DNA, 13 bp, Artificial Sequence
  synthetic sequence
gaaaagcatattg

SEQ ID NO: 3743 - DNA, 13 bp, Artificial Sequence
  synthetic sequence
ttgaagactcgca

SEQ ID NO: 3744 - DNA, 13 bp, Artificial Sequence
  synthetic sequence
aagataccatcaa

SEQ ID NO: 3745 - DNA, 13 bp, Artificial Sequence
  synthetic sequence
tggcatttgggtc

SEQ ID NO: 3746 - DNA, 13 bp, Artificial Sequence
  synthetic sequence
tatggggacactt

SEQ ID NO: 3747 - DNA, 13 bp, Artificial Sequence
  synthetic sequence
atgtaggatcaga

SEQ ID NO: 3748 - DNA, 13 bp, Artificial Sequence
  synthetic sequence
cgaggactgtgga

SEQ ID NO: 3749 - DNA, 13 bp, Artificial Sequence
  synthetic sequence
gtaggaaaagcaa

SEQ ID NO: 3750 - DNA, 13 bp, Artificial Sequence
  synthetic sequence
tatggggatacct

SEQ ID NO: 3751 - DNA, 13 bp, Artificial Sequence
  synthetic sequence
aaaaagtgttgct

SEQ ID NO: 3752 - DNA, 13 bp, Artificial Sequence
  synthetic sequence
tttaattgtagag

SEQ ID NO: 3753 - DNA, 13 bp, Artificial Sequence
  synthetic sequence
tatataatacagt

SEQ ID NO: 3754 - DNA, 13 bp, Artificial Sequence
  synthetic sequence
tgattgtgtggca

SEQ ID NO: 3755 - DNA, 13 bp, Artificial Sequence
  synthetic sequence
ccggctggttttg

SEQ ID NO: 3756 - DNA, 13 bp, Artificial Sequence
  synthetic sequence
tgggagtttgtta

SEQ ID NO: 3757 - DNA, 13 bp, Artificial Sequence
  synthetic sequence
aaaatgacatggt

SEQ ID NO: 3758 - DNA, 13 bp, Artificial Sequence
  synthetic sequence
taatagtacatct

SEQ ID NO: 3759 - DNA, 13 bp, Artificial Sequence
  synthetic sequence
tggggctgctctg

SEQ ID NO: 3760 - DNA, 13 bp, Artificial Sequence
  synthetic sequence
tataggttgataa

SEQ ID NO: 3761 - DNA, 13 bp, Artificial Sequence
  synthetic sequence
agtatactgcatt

SEQ ID NO: 3762 - DNA, 13 bp, Artificial Sequence
  synthetic sequence
taattgatagaat

SEQ ID NO: 3763 - DNA, 13 bp, Artificial Sequence
  synthetic sequence
ccacctttaccta

SEQ ID NO: 3764 - DNA, 13 bp, Artificial Sequence
  synthetic sequence
gtcagtcaaaatt

SEQ ID NO: 3765 - DNA, 13 bp, Artificial Sequence
  synthetic sequence
tcagagcagtaag

SEQ ID NO: 3766 - DNA, 13 bp, Artificial Sequence
  synthetic sequence
aaatcataatagt

SEQ ID NO: 3767 - DNA, 13 bp, Artificial Sequence
  synthetic sequence
aagaagaacatga

SEQ ID NO: 3768 - DNA, 13 bp, Artificial Sequence
  synthetic sequence
attctaaaatgta

SEQ ID NO: 3769 - DNA, 13 bp, Artificial Sequence
  synthetic sequence
actcacccttgtc

SEQ ID NO: 3770 - DNA, 13 bp, Artificial Sequence
  synthetic sequence
aggaccagcagga

SEQ ID NO: 3771 - DNA, 13 bp, Artificial Sequence
  synthetic sequence
actcaccattgtc

SEQ ID NO: 3772 - DNA, 13 bp, Artificial Sequence
  synthetic sequence
actgcttgtaaca

SEQ ID NO: 3773 - DNA, 13 bp, Artificial Sequence
  synthetic sequence
gggattaaagtaa

SEQ ID NO: 3774 - DNA, 13 bp, Artificial Sequence
  synthetic sequence
ccaacagccccac

SEQ ID NO: 3775 - DNA, 13 bp, Artificial Sequence
  synthetic sequence
cagcagcagaagg

SEQ ID NO: 3776 - DNA, 13 bp, Artificial Sequence
  synthetic sequence
agatcttcagacc

SEQ ID NO: 3777 - DNA, 13 bp, Artificial Sequence
  synthetic sequence
tgttattgtaaac

SEQ ID NO: 3778 - DNA, 13 bp, Artificial Sequence
  synthetic sequence
aatagactggtta

SEQ ID NO: 3779 - DNA, 13 bp, Artificial Sequence
  synthetic sequence
catagcaattgga

SEQ ID NO: 3780 - DNA, 13 bp, Artificial Sequence
  synthetic sequence
gatgacttgtatg

SEQ ID NO: 3781 - DNA, 13 bp, Artificial Sequence
  synthetic sequence
tcacagacaatgc

SEQ ID NO: 3782 - DNA, 13 bp, Artificial Sequence
  synthetic sequence
tgggacacagcag

SEQ ID NO: 3783 - DNA, 13 bp, Artificial Sequence
  synthetic sequence
tacttgatagaat

SEQ ID NO: 3784 - DNA, 13 bp, Artificial Sequence
  synthetic sequence
tatcaagagccat

SEQ ID NO: 3785 - DNA, 13 bp, Artificial Sequence
  synthetic sequence
tattaagcggggg

SEQ ID NO: 3786 - DNA, 13 bp, Artificial Sequence
  synthetic sequence
acataagacaagc

SEQ ID NO: 3787 - DNA, 13 bp, Artificial Sequence
  synthetic sequence
cactgacagcatt

SEQ ID NO: 3788 - DNA, 13 bp, Artificial Sequence
  synthetic sequence
agaatgtggcaga

SEQ ID NO: 3789 - DNA, 13 bp, Artificial Sequence
  synthetic sequence
ataaaagatggat

SEQ ID NO: 3790 - DNA, 13 bp, Artificial Sequence
  synthetic sequence
cagcagcagaggg

SEQ ID NO: 3791 - DNA, 13 bp, Artificial Sequence
  synthetic sequence
tctattatggggt

SEQ ID NO: 3792 - DNA, 13 bp, Artificial Sequence
  synthetic sequence
tataggttaataa

SEQ ID NO: 3793 - DNA, 13 bp, Artificial Sequence
  synthetic sequence
aagcacaagagga

SEQ ID NO: 3794 - DNA, 13 bp, Artificial Sequence
  synthetic sequence
actcacctctgtc

SEQ ID NO: 3795 - DNA, 13 bp, Artificial Sequence
  synthetic sequence
aggggatataaga

SEQ ID NO: 3796 - DNA, 13 bp, Artificial Sequence
  synthetic sequence
agggggagatatg

SEQ ID NO: 3797 - DNA, 13 bp, Artificial Sequence
  synthetic sequence
caagaaaagaatg

SEQ ID NO: 3798 - DNA, 13 bp, Artificial Sequence
  synthetic sequence
gggggacatcaag

SEQ ID NO: 3799 - DNA, 13 bp, Artificial Sequence
  synthetic sequence
atatgtggaaaaa

SEQ ID NO: 3800 - DNA, 13 bp, Artificial Sequence
  synthetic sequence
tgtgctccagctg

SEQ ID NO: 3801 - DNA, 13 bp, Artificial Sequence
  synthetic sequence
ttggaagaaatat

SEQ ID NO: 3802 - DNA, 13 bp, Artificial Sequence
  synthetic sequence
cagcagatggggt

SEQ ID NO: 3803 - DNA, 13 bp, Artificial Sequence
  synthetic sequence
ctctcaagacagg

SEQ ID NO: 3804 - DNA, 13 bp, Artificial Sequence
  synthetic sequence
tggggttgctctg

SEQ ID NO: 3805 - DNA, 13 bp, Artificial Sequence
  synthetic sequence
gtcagcctaagac

SEQ ID NO: 3806 - DNA, 13 bp, Artificial Sequence
  synthetic sequence
gtacagatggcag

SEQ ID NO: 3807 - DNA, 13 bp, Artificial Sequence
  synthetic sequence
ataggaaatataa

SEQ ID NO: 3808 - DNA, 13 bp, Artificial Sequence
  synthetic sequence
actcaccattatc

SEQ ID NO: 3809 - DNA, 13 bp, Artificial Sequence
  synthetic sequence
gttggaagtgtgg

SEQ ID NO: 3810 - DNA, 13 bp, Artificial Sequence
  synthetic sequence
aagttccagagaa

SEQ ID NO: 3811 - DNA, 13 bp, Artificial Sequence
  synthetic sequence
tttaatacagtag

SEQ ID NO: 3812 - DNA, 13 bp, Artificial Sequence
  synthetic sequence
atcattcaagcac

SEQ ID NO: 3813 - DNA, 13 bp, Artificial Sequence
  synthetic sequence
caggaacaaaatg

SEQ ID NO: 3814 - DNA, 13 bp, Artificial Sequence
  synthetic sequence
tttgggacagacc

SEQ ID NO: 3815 - DNA, 13 bp, Artificial Sequence
  synthetic sequence
taatagtacacct

SEQ ID NO: 3816 - DNA, 13 bp, Artificial Sequence
  synthetic sequence
ataacaggagata

SEQ ID NO: 3817 - DNA, 13 bp, Artificial Sequence
  synthetic sequence
cagaagttatccc

SEQ ID NO: 3818 - DNA, 13 bp, Artificial Sequence
  synthetic sequence
gatcatcaaaatc

SEQ ID NO: 3819 - DNA, 13 bp, Artificial Sequence
  synthetic sequence
tctactatggggt

SEQ ID NO: 3820 - DNA, 13 bp, Artificial Sequence
  synthetic sequence
cctatagtgcaga

SEQ ID NO: 3821 - DNA, 13 bp, Artificial Sequence
  synthetic sequence
tatggagtacctg

SEQ ID NO: 3822 - DNA, 13 bp, Artificial Sequence
  synthetic sequence
caggagaaaagga

SEQ ID NO: 3823 - DNA, 13 bp, Artificial Sequence
  synthetic sequence
tgggagtttgtca

SEQ ID NO: 3824 - DNA, 13 bp, Artificial Sequence
  synthetic sequence
cacccttgcctag

SEQ ID NO: 3825 - DNA, 13 bp, Artificial Sequence
  synthetic sequence
tgctattgcaaaa

SEQ ID NO: 3826 - DNA, 13 bp, Artificial Sequence
  synthetic sequence
aggaaattggtaa

SEQ ID NO: 3827 - DNA, 13 bp, Artificial Sequence
  synthetic sequence
taatagtacagtt

SEQ ID NO: 3828 - DNA, 13 bp, Artificial Sequence
  synthetic sequence
ctgagccagcagc

SEQ ID NO: 3829 - DNA, 13 bp, Artificial Sequence
  synthetic sequence
gaaaatggatagt

SEQ ID NO: 3830 - DNA, 13 bp, Artificial Sequence
  synthetic sequence
gggatgggggaag

SEQ ID NO: 3831 - DNA, 13 bp, Artificial Sequence
  synthetic sequence
tgtgctccagcag

SEQ ID NO: 3832 - DNA, 13 bp, Artificial Sequence
  synthetic sequence
caatggacatacc

SEQ ID NO: 3833 - DNA, 13 bp, Artificial Sequence
  synthetic sequence
atgaaaaatatca

SEQ ID NO: 3834 - DNA, 13 bp, Artificial Sequence
  synthetic sequence
ctgaaaatcctta

SEQ ID NO: 3835 - DNA, 13 bp, Artificial Sequence
  synthetic sequence
atgatttatatgt

SEQ ID NO: 3836 - DNA, 13 bp, Artificial Sequence
  synthetic sequence
tatggagacactt

SEQ ID NO: 3837 - DNA, 13 bp, Artificial Sequence
  synthetic sequence
gagtttttctatt

SEQ ID NO: 3838 - DNA, 13 bp, Artificial Sequence
  synthetic sequence
aaacctccgacgc

SEQ ID NO: 3839 - DNA, 13 bp, Artificial Sequence
  synthetic sequence
ggagaaaaatgaa

SEQ ID NO: 3840 - DNA, 13 bp, Artificial Sequence
  synthetic sequence
gagagcttcaggt

SEQ ID NO: 3841 - DNA, 13 bp, Artificial Sequence
  synthetic sequence
tcgttgcagaccc

SEQ ID NO: 3842 - DNA, 13 bp, Artificial Sequence
  synthetic sequence
ataatagtacaac

SEQ ID NO: 3843 - DNA, 13 bp, Artificial Sequence
  synthetic sequence
actagcagcatta

SEQ ID NO: 3844 - DNA, 13 bp, Artificial Sequence
  synthetic sequence
ggagtgggaggac

SEQ ID NO: 3845 - DNA, 13 bp, Artificial Sequence
  synthetic sequence
taatagtgcagct

SEQ ID NO: 3846 - DNA, 13 bp, Artificial Sequence
  synthetic sequence
ttgggttcttagg

SEQ ID NO: 3847 - DNA, 13 bp, Artificial Sequence
  synthetic sequence
ctcttcagacagg

SEQ ID NO: 3848 - DNA, 13 bp, Artificial Sequence
  synthetic sequence
aatgagaccccag

SEQ ID NO: 3849 - DNA, 13 bp, Artificial Sequence
  synthetic sequence
cagcagcaacagg

SEQ ID NO: 3850 - DNA, 13 bp, Artificial Sequence
  synthetic sequence
ccatacaatactc

SEQ ID NO: 3851 - DNA, 13 bp, Artificial Sequence
  synthetic sequence
aaaattacatggt

SEQ ID NO: 3852 - DNA, 13 bp, Artificial Sequence
  synthetic sequence
gaaaccttcagac

SEQ ID NO: 3853 - DNA, 13 bp, Artificial Sequence
  synthetic sequence
tcagactcatcaa

SEQ ID NO: 3854 - DNA, 13 bp, Artificial Sequence
  synthetic sequence
tttggcaacgacc

SEQ ID NO: 3855 - DNA, 13 bp, Artificial Sequence
  synthetic sequence
aatcgcagaacca

SEQ ID NO: 3856 - DNA, 13 bp, Artificial Sequence
  synthetic sequence
actgcttgtaata

SEQ ID NO: 3857 - DNA, 13 bp, Artificial Sequence
  synthetic sequence
tgcagaataaagc

SEQ ID NO: 3858 - DNA, 13 bp, Artificial Sequence
  synthetic sequence
tcagcaactccta

SEQ ID NO: 3859 - DNA, 13 bp, Artificial Sequence
  synthetic sequence
ctctcgacgcaag

SEQ ID NO: 3860 - DNA, 13 bp, Artificial Sequence
  synthetic sequence
tattacagggaca

SEQ ID NO: 3861 - DNA, 13 bp, Artificial Sequence
  synthetic sequence
ccataggaggaca

SEQ ID NO: 3862 - DNA, 13 bp, Artificial Sequence
  synthetic sequence
agatgggtgcgag

SEQ ID NO: 3863 - DNA, 13 bp, Artificial Sequence
  synthetic sequence
actccttgtaata

SEQ ID NO: 3864 - DNA, 13 bp, Artificial Sequence
  synthetic sequence
ttcagacctgcag

SEQ ID NO: 3865 - DNA, 13 bp, Artificial Sequence
  synthetic sequence
atcaacccctctc

SEQ ID NO: 3866 - DNA, 13 bp, Artificial Sequence
  synthetic sequence
ttgtaacattagt

SEQ ID NO: 3867 - DNA, 13 bp, Artificial Sequence
  synthetic sequence
ccgcctttgccta

SEQ ID NO: 3868 - DNA, 13 bp, Artificial Sequence
  synthetic sequence
ggcttcccagtca

SEQ ID NO: 3869 - DNA, 13 bp, Artificial Sequence
  synthetic sequence
acaggaaacagca

SEQ ID NO: 3870 - DNA, 13 bp, Artificial Sequence
  synthetic sequence
gcaggtagcacta

SEQ ID NO: 3871 - DNA, 13 bp, Artificial Sequence
  synthetic sequence
taattggaagaaa

SEQ ID NO: 3872 - DNA, 13 bp, Artificial Sequence
  synthetic sequence
ctcccctacccag

SEQ ID NO: 3873 - DNA, 13 bp, Artificial Sequence
  synthetic sequence
gtcaaaattaccc

SEQ ID NO: 3874 - DNA, 13 bp, Artificial Sequence
  synthetic sequence
atgccaggggaaa

SEQ ID NO: 3875 - DNA, 13 bp, Artificial Sequence
  synthetic sequence
aaaactgctcttt

SEQ ID NO: 3876 - DNA, 13 bp, Artificial Sequence
  synthetic sequence
cagaaggagtagg

SEQ ID NO: 3877 - DNA, 13 bp, Artificial Sequence
  synthetic sequence
aatatactgcatt

SEQ ID NO: 3878 - DNA, 13 bp, Artificial Sequence
  synthetic sequence
tgggttttccagt

SEQ ID NO: 3879 - DNA, 13 bp, Artificial Sequence
  synthetic sequence
ctcagtcattaca

SEQ ID NO: 3880 - DNA, 13 bp, Artificial Sequence
  synthetic sequence
ccagtaagacctc

SEQ ID NO: 3881 - DNA, 13 bp, Artificial Sequence
  synthetic sequence
ttaagacaaagaa

SEQ ID NO: 3882 - DNA, 13 bp, Artificial Sequence
  synthetic sequence
aaaagaaaataga

SEQ ID NO: 3883 - DNA, 13 bp, Artificial Sequence
  synthetic sequence
gctggaaatgtgg

SEQ ID NO: 3884 - DNA, 13 bp, Artificial Sequence
  synthetic sequence
caggagaaaaaga

SEQ ID NO: 3885 - DNA, 13 bp, Artificial Sequence
  synthetic sequence
aaggggttgaagc

SEQ ID NO: 3886 - DNA, 13 bp, Artificial Sequence
  synthetic sequence
cagacccttaccc

SEQ ID NO: 3887 - DNA, 13 bp, Artificial Sequence
  synthetic sequence
tatatcaggatga

SEQ ID NO: 3888 - DNA, 13 bp, Artificial Sequence
  synthetic sequence
tatgcaacagtct

SEQ ID NO: 3889 - DNA, 13 bp, Artificial Sequence
  synthetic sequence
caggaaaagaatg

SEQ ID NO: 3890 - DNA, 13 bp, Artificial Sequence
  synthetic sequence
ctcctgctccagc

SEQ ID NO: 3891 - DNA, 13 bp, Artificial Sequence
  synthetic sequence
tttattatggggt

SEQ ID NO: 3892 - DNA, 13 bp, Artificial Sequence
  synthetic sequence
taataaactgtaa

SEQ ID NO: 3893 - DNA, 13 bp, Artificial Sequence
  synthetic sequence
agaagagatgatg

SEQ ID NO: 3894 - DNA, 13 bp, Artificial Sequence
  synthetic sequence
gcagtgcaaatgg

SEQ ID NO: 3895 - DNA, 13 bp, Artificial Sequence
  synthetic sequence
tgggaatttgtca

SEQ ID NO: 3896 - DNA, 13 bp, Artificial Sequence
  synthetic sequence
tcaggggactaca

SEQ ID NO: 3897 - DNA, 13 bp, Artificial Sequence
  synthetic sequence
agaataagacaaa

SEQ ID NO: 3898 - DNA, 13 bp, Artificial Sequence
  synthetic sequence
gtaaggtcatgga

SEQ ID NO: 3899 - DNA, 13 bp, Artificial Sequence
  synthetic sequence
agacattcagacc

SEQ ID NO: 3900 - DNA, 13 bp, Artificial Sequence
  synthetic sequence
aattcttttattg

SEQ ID NO: 3901 - DNA, 13 bp, Artificial Sequence
  synthetic sequence
tgcacctggagta

SEQ ID NO: 3902 - DNA, 13 bp, Artificial Sequence
  synthetic sequence
cacccctgcctag

SEQ ID NO: 3903 - DNA, 13 bp, Artificial Sequence
  synthetic sequence
aagggactgagac

SEQ ID NO: 3904 - DNA, 13 bp, Artificial Sequence
  synthetic sequence
aggaacagaagaa

SEQ ID NO: 3905 - DNA, 13 bp, Artificial Sequence
  synthetic sequence
aggcacattgtaa

SEQ ID NO: 3906 - DNA, 13 bp, Artificial Sequence
  synthetic sequence
gacttggactgtg

SEQ ID NO: 3907 - DNA, 13 bp, Artificial Sequence
  synthetic sequence
tgggaatttgtta

SEQ ID NO: 3908 - DNA, 13 bp, Artificial Sequence
  synthetic sequence
attgggccagtca

SEQ ID NO: 3909 - DNA, 13 bp, Artificial Sequence
  synthetic sequence
tgtaatgataaga

SEQ ID NO: 3910 - DNA, 13 bp, Artificial Sequence
  synthetic sequence
agccacctttgcc

SEQ ID NO: 3911 - DNA, 13 bp, Artificial Sequence
  synthetic sequence
catgagaaatatc

SEQ ID NO: 3912 - DNA, 13 bp, Artificial Sequence
  synthetic sequence
aacaatgctaaaa

SEQ ID NO: 3913 - DNA, 13 bp, Artificial Sequence
  synthetic sequence
tacttacagaatc

SEQ ID NO: 3914 - DNA, 13 bp, Artificial Sequence
  synthetic sequence
acaggatcagagg

SEQ ID NO: 3915 - DNA, 13 bp, Artificial Sequence
  synthetic sequence
ggacaccaggcag

SEQ ID NO: 3916 - DNA, 13 bp, Artificial Sequence
  synthetic sequence
aactgcttgcaat

SEQ ID NO: 3917 - DNA, 13 bp, Artificial Sequence
  synthetic sequence
aacaatgccaaaa

SEQ ID NO: 3918 - DNA, 13 bp, Artificial Sequence
  synthetic sequence
tcctccagcagca

SEQ ID NO: 3919 - DNA, 13 bp, Artificial Sequence
  synthetic sequence
actcacctttatc

SEQ ID NO: 3920 - DNA, 13 bp, Artificial Sequence
  synthetic sequence
agcgaggattgtg

SEQ ID NO: 3921 - DNA, 13 bp, Artificial Sequence
  synthetic sequence
ttgaaaaatcgca

SEQ ID NO: 3922 - DNA, 13 bp, Artificial Sequence
  synthetic sequence
atatgttgactca

SEQ ID NO: 3923 - DNA, 13 bp, Artificial Sequence
  synthetic sequence
taggggacataag

SEQ ID NO: 3924 - DNA, 13 bp, Artificial Sequence
  synthetic sequence
actcacctgtgtc

SEQ ID NO: 3925 - DNA, 13 bp, Artificial Sequence
  synthetic sequence
gatctgacttaga

SEQ ID NO: 3926 - DNA, 13 bp, Artificial Sequence
  synthetic sequence
agatttacccagg

SEQ ID NO: 3927 - DNA, 13 bp, Artificial Sequence
  synthetic sequence
agcgaggactgtg

SEQ ID NO: 3928 - DNA, 13 bp, Artificial Sequence
  synthetic sequence
ttgcaatacctca

SEQ ID NO: 3929 - DNA, 13 bp, Artificial Sequence
  synthetic sequence
caacagctccacc

SEQ ID NO: 3930 - DNA, 13 bp, Artificial Sequence
  synthetic sequence
caaaaccaacaag

SEQ ID NO: 3931 - DNA, 13 bp, Artificial Sequence
  synthetic sequence
ggccagggggaaa

SEQ ID NO: 3932 - DNA, 13 bp, Artificial Sequence
  synthetic sequence
tagaacaaatgca

SEQ ID NO: 3933 - DNA, 13 bp, Artificial Sequence
  synthetic sequence
atgaaagatatca

SEQ ID NO: 3934 - DNA, 13 bp, Artificial Sequence
  synthetic sequence
tgctattgtaaag

SEQ ID NO: 3935 - DNA, 13 bp, Artificial Sequence
  synthetic sequence
tcactatacctag

SEQ ID NO: 3936 - DNA, 13 bp, Artificial Sequence
  synthetic sequence
ggacatcaggcag

SEQ ID NO: 3937 - DNA, 13 bp, Artificial Sequence
  synthetic sequence
aaccagcaagaaa

SEQ ID NO: 3938 - DNA, 13 bp, Artificial Sequence
  synthetic sequence
gagatattcagac

SEQ ID NO: 3939 - DNA, 13 bp, Artificial Sequence
  synthetic sequence
ataaaaccaaaaa

SEQ ID NO: 3940 - DNA, 13 bp, Artificial Sequence
  synthetic sequence
aataaataggtta

SEQ ID NO: 3941 - DNA, 13 bp, Artificial Sequence
  synthetic sequence
taagacaaacccc

SEQ ID NO: 3942 - DNA, 13 bp, Artificial Sequence
  synthetic sequence
caggagttgaagc

SEQ ID NO: 3943 - DNA, 13 bp, Artificial Sequence
  synthetic sequence
cagcaggaagcac

SEQ ID NO: 3944 - DNA, 13 bp, Artificial Sequence
  synthetic sequence
tgataaattgtaa

SEQ ID NO: 3945 - DNA, 13 bp, Artificial Sequence
  synthetic sequence
ggagaaataaaaa

SEQ ID NO: 3946 - DNA, 13 bp, Artificial Sequence
  synthetic sequence
atggagagttctt

SEQ ID NO: 3947 - DNA, 13 bp, Artificial Sequence
  synthetic sequence
attgtaatgcaca

SEQ ID NO: 3948 - DNA, 13 bp, Artificial Sequence
  synthetic sequence
tagtgaccctaaa

SEQ ID NO: 3949 - DNA, 13 bp, Artificial Sequence
  synthetic sequence
cacccatgttgct

SEQ ID NO: 3950 - DNA, 13 bp, Artificial Sequence
  synthetic sequence
tggacatatcaga

SEQ ID NO: 3951 - DNA, 13 bp, Artificial Sequence
  synthetic sequence
ggggaaaattaga

SEQ ID NO: 3952 - DNA, 13 bp, Artificial Sequence
  synthetic sequence
aaaattgctcttt

SEQ ID NO: 3953 - DNA, 13 bp, Artificial Sequence
  synthetic sequence
gaaacaggacaag

SEQ ID NO: 3954 - DNA, 13 bp, Artificial Sequence
  synthetic sequence
catataacactcc

SEQ ID NO: 3955 - DNA, 13 bp, Artificial Sequence
  synthetic sequence
cccttcagacagg

SEQ ID NO: 3956 - DNA, 13 bp, Artificial Sequence
  synthetic sequence
taatagtgcacct

SEQ ID NO: 3957 - DNA, 13 bp, Artificial Sequence
  synthetic sequence
atgcagaataaaa

SEQ ID NO: 3958 - DNA, 13 bp, Artificial Sequence
  synthetic sequence
tcaaaacagtaag

SEQ ID NO: 3959 - DNA, 13 bp, Artificial Sequence
  synthetic sequence
aagcatattgtaa

SEQ ID NO: 3960 - DNA, 13 bp, Artificial Sequence
  synthetic sequence
caggagtggaagc

SEQ ID NO: 3961 - DNA, 13 bp, Artificial Sequence
  synthetic sequence
tatgggcaagcag

SEQ ID NO: 3962 - DNA, 13 bp, Artificial Sequence
  synthetic sequence
ctgaaccagcagc

SEQ ID NO: 3963 - DNA, 13 bp, Artificial Sequence
  synthetic sequence
ccccaccagcaga

SEQ ID NO: 3964 - DNA, 13 bp, Artificial Sequence
  synthetic sequence
aataagacattca

SEQ ID NO: 3965 - DNA, 13 bp, Artificial Sequence
  synthetic sequence
cagacccctaccc

SEQ ID NO: 3966 - DNA, 13 bp, Artificial Sequence
  synthetic sequence
cagatgcatgaag

SEQ ID NO: 3967 - DNA, 13 bp, Artificial Sequence
  synthetic sequence
ccctccagcagca

SEQ ID NO: 3968 - DNA, 13 bp, Artificial Sequence
  synthetic sequence
aactgcttgtagc

SEQ ID NO: 3969 - DNA, 13 bp, Artificial Sequence
  synthetic sequence
gagccaacagccc

SEQ ID NO: 3970 - DNA, 13 bp, Artificial Sequence
  synthetic sequence
gataaaacaaatt

SEQ ID NO: 3971 - DNA, 13 bp, Artificial Sequence
  synthetic sequence
ggaggagacatga

SEQ ID NO: 3972 - DNA, 13 bp, Artificial Sequence
  synthetic sequence
aagcatattgtga

SEQ ID NO: 3973 - DNA, 13 bp, Artificial Sequence
  synthetic sequence
ttacaacacatag

SEQ ID NO: 3974 - DNA, 13 bp, Artificial Sequence
  synthetic sequence
aatagataggtta

SEQ ID NO: 3975 - DNA, 13 bp, Artificial Sequence
  synthetic sequence
gtgggctttccag

SEQ ID NO: 3976 - DNA, 13 bp, Artificial Sequence
  synthetic sequence
agaagttattcca

SEQ ID NO: 3977 - DNA, 13 bp, Artificial Sequence
  synthetic sequence
ttgaagaatcaca

SEQ ID NO: 3978 - DNA, 13 bp, Artificial Sequence
  synthetic sequence
aaatccagcagga

SEQ ID NO: 3979 - DNA, 13 bp, Artificial Sequence
  synthetic sequence
agatacctacagg

SEQ ID NO: 3980 - DNA, 13 bp, Artificial Sequence
  synthetic sequence
ggtcacagtctat

SEQ ID NO: 3981 - DNA, 13 bp, Artificial Sequence
  synthetic sequence
cctgttaatatta

SEQ ID NO: 3982 - DNA, 13 bp, Artificial Sequence
  synthetic sequence
ggacaacatatct

SEQ ID NO: 3983 - DNA, 13 bp, Artificial Sequence
  synthetic sequence
aagttgtaacacc

SEQ ID NO: 3984 - DNA, 13 bp, Artificial Sequence
  synthetic sequence
cactaaaagcatt

SEQ ID NO: 3985 - DNA, 13 bp, Artificial Sequence
  synthetic sequence
tttggcagcgacc

SEQ ID NO: 3986 - DNA, 13 bp, Artificial Sequence
  synthetic sequence
caaacccagcagg

SEQ ID NO: 3987 - DNA, 13 bp, Artificial Sequence
  synthetic sequence
actccttgtacca

SEQ ID NO: 3988 - DNA, 13 bp, Artificial Sequence
  synthetic sequence
tcctgcagcagca

SEQ ID NO: 3989 - DNA, 13 bp, Artificial Sequence
  synthetic sequence
aattgggcgagtc

SEQ ID NO: 3990 - DNA, 13 bp, Artificial Sequence
  synthetic sequence
gacaatgctaaaa

SEQ ID NO: 3991 - DNA, 13 bp, Artificial Sequence
  synthetic sequence
acaggaacagagg

SEQ ID NO: 3992 - DNA, 13 bp, Artificial Sequence
  synthetic sequence
aatcatcaagatc

SEQ ID NO: 3993 - DNA, 13 bp, Artificial Sequence
  synthetic sequence
acatagtgacaga

SEQ ID NO: 3994 - DNA, 13 bp, Artificial Sequence
  synthetic sequence
gataaagcaaatt

SEQ ID NO: 3995 - DNA, 13 bp, Artificial Sequence
  synthetic sequence
ggcatcaagcagc

SEQ ID NO: 3996 - DNA, 13 bp, Artificial Sequence
  synthetic sequence
attgagagaataa

SEQ ID NO: 3997 - DNA, 13 bp, Artificial Sequence
  synthetic sequence
ctatagtgcaaaa

SEQ ID NO: 3998 - DNA, 13 bp, Artificial Sequence
  synthetic sequence
atctgacagacaa

SEQ ID NO: 3999 - DNA, 13 bp, Artificial Sequence
  synthetic sequence
ctcctcaagacag

SEQ ID NO: 4000 - DNA, 13 bp, Artificial Sequence
  synthetic sequence
agaataagacaag

SEQ ID NO: 4001 - DNA, 13 bp, Artificial Sequence
  synthetic sequence
tatagactaataa

SEQ ID NO: 4002 - DNA, 13 bp, Artificial Sequence
  synthetic sequence
gtaggttttccag

SEQ ID NO: 4003 - DNA, 13 bp, Artificial Sequence
  synthetic sequence
agagaaagccacc

SEQ ID NO: 4004 - DNA, 13 bp, Artificial Sequence
  synthetic sequence
gtggaacttctgg

SEQ ID NO: 4005 - DNA, 13 bp, Artificial Sequence
  synthetic sequence
tcgttccagaccc

SEQ ID NO: 4006 - DNA, 13 bp, Artificial Sequence
  synthetic sequence
actcggcttgctg

SEQ ID NO: 4007 - DNA, 13 bp, Artificial Sequence
  synthetic sequence
taggaaacataag

SEQ ID NO: 4008 - DNA, 13 bp, Artificial Sequence
  synthetic sequence
ttagataaatggg

SEQ ID NO: 4009 - DNA, 13 bp, Artificial Sequence
  synthetic sequence
ggcacttgggtca

SEQ ID NO: 4010 - DNA, 13 bp, Artificial Sequence
  synthetic sequence
agagggggtggga

SEQ ID NO: 4011 - DNA, 13 bp, Artificial Sequence
  synthetic sequence
ttttaatatgtgg

SEQ ID NO: 4012 - DNA, 13 bp, Artificial Sequence
  synthetic sequence
tcaaaatcctgta

SEQ ID NO: 4013 - DNA, 13 bp, Artificial Sequence
  synthetic sequence
agactttcagacc

SEQ ID NO: 4014 - DNA, 13 bp, Artificial Sequence
  synthetic sequence
aaatcttcagacc

SEQ ID NO: 4015 - DNA, 13 bp, Artificial Sequence
  synthetic sequence
tataggctaataa

SEQ ID NO: 4016 - DNA, 13 bp, Artificial Sequence
  synthetic sequence
taatactagctat

SEQ ID NO: 4017 - DNA, 13 bp, Artificial Sequence
  synthetic sequence
agtatagattaat

SEQ ID NO: 4018 - DNA, 13 bp, Artificial Sequence
  synthetic sequence
tatggggtgcctg

SEQ ID NO: 4019 - DNA, 13 bp, Artificial Sequence
  synthetic sequence
agcagaaggggtg

SEQ ID NO: 4020 - DNA, 13 bp, Artificial Sequence
  synthetic sequence
aatgcacaagggc

SEQ ID NO: 4021 - DNA, 13 bp, Artificial Sequence
  synthetic sequence
gagtatccataga

SEQ ID NO: 4022 - DNA, 13 bp, Artificial Sequence
  synthetic sequence
gatgacttatatg

SEQ ID NO: 4023 - DNA, 13 bp, Artificial Sequence
  synthetic sequence
ggcaggaggtagg

SEQ ID NO: 4024 - DNA, 13 bp, Artificial Sequence
  synthetic sequence
cagcagagggagt

SEQ ID NO: 4025 - DNA, 13 bp, Artificial Sequence
  synthetic sequence
aacagtgtactat

SEQ ID NO: 4026 - DNA, 13 bp, Artificial Sequence
  synthetic sequence
atacaggctaata

SEQ ID NO: 4027 - DNA, 13 bp, Artificial Sequence
  synthetic sequence
caggaaagaaatg

SEQ ID NO: 4028 - DNA, 13 bp, Artificial Sequence
  synthetic sequence
tcacaaataatgc

SEQ ID NO: 4029 - DNA, 13 bp, Artificial Sequence
  synthetic sequence
aacaccaaaaagg

SEQ ID NO: 4030 - DNA, 13 bp, Artificial Sequence
  synthetic sequence
actccttgtacta

SEQ ID NO: 4031 - DNA, 13 bp, Artificial Sequence
  synthetic sequence
agaattagacagg

SEQ ID NO: 4032 - DNA, 13 bp, Artificial Sequence
  synthetic sequence
aggagacataaga

SEQ ID NO: 4033 - DNA, 13 bp, Artificial Sequence
  synthetic sequence
tgcagggccccta

SEQ ID NO: 4034 - DNA, 13 bp, Artificial Sequence
  synthetic sequence
gaactgagccagc

SEQ ID NO: 4035 - DNA, 13 bp, Artificial Sequence
  synthetic sequence
aaagcgaaagtaa

SEQ ID NO: 4036 - DNA, 13 bp, Artificial Sequence
  synthetic sequence
cagaagaaaatag

SEQ ID NO: 4037 - DNA, 13 bp, Artificial Sequence
  synthetic sequence
accccttgtaata

SEQ ID NO: 4038 - DNA, 13 bp, Artificial Sequence
  synthetic sequence
aactcctccagca

SEQ ID NO: 4039 - DNA, 13 bp, Artificial Sequence
  synthetic sequence
gctgaacatctta

SEQ ID NO: 4040 - DNA, 13 bp, Artificial Sequence
  synthetic sequence
tcgttacagaccc

SEQ ID NO: 4041 - DNA, 13 bp, Artificial Sequence
  synthetic sequence
ctgtcaacataat

SEQ ID NO: 4042 - DNA, 13 bp, Artificial Sequence
  synthetic sequence
agcagcaccagga

SEQ ID NO: 4043 - DNA, 13 bp, Artificial Sequence
  synthetic sequence
gtaacacctcagt

SEQ ID NO: 4044 - DNA, 13 bp, Artificial Sequence
  synthetic sequence
tattacagagaca

SEQ ID NO: 4045 - DNA, 13 bp, Artificial Sequence
  synthetic sequence
ggaattaaagtaa

SEQ ID NO: 4046 - DNA, 13 bp, Artificial Sequence
  synthetic sequence
ataagacaagcac

SEQ ID NO: 4047 - DNA, 13 bp, Artificial Sequence
  synthetic sequence
ttgtaatgtctca

SEQ ID NO: 4048 - DNA, 13 bp, Artificial Sequence
  synthetic sequence
gtaggtttcccag

SEQ ID NO: 4049 - DNA, 13 bp, Artificial Sequence
  synthetic sequence
aactctagtgagt

SEQ ID NO: 4050 - DNA, 13 bp, Artificial Sequence
  synthetic sequence
ctctcaaaacagg

SEQ ID NO: 4051 - DNA, 13 bp, Artificial Sequence
  synthetic sequence
tggagacacctgg

SEQ ID NO: 4052 - DNA, 13 bp, Artificial Sequence
  synthetic sequence
aataaactggtta

SEQ ID NO: 4053 - DNA, 13 bp, Artificial Sequence
  synthetic sequence
gtcagcctaggac

SEQ ID NO: 4054 - DNA, 13 bp, Artificial Sequence
  synthetic sequence
catagtaattgga

SEQ ID NO: 4055 - DNA, 13 bp, Artificial Sequence
  synthetic sequence
gatagacaggtta

SEQ ID NO: 4056 - DNA, 13 bp, Artificial Sequence
  synthetic sequence
cagctataggttg

SEQ ID NO: 4057 - DNA, 13 bp, Artificial Sequence
  synthetic sequence
atctgtatgtagg

SEQ ID NO: 4058 - DNA, 13 bp, Artificial Sequence
  synthetic sequence
gagagcttcgggt

SEQ ID NO: 4059 - DNA, 13 bp, Artificial Sequence
  synthetic sequence
cgaaagtagaacc

SEQ ID NO: 4060 - DNA, 13 bp, Artificial Sequence
  synthetic sequence
atgggtgcgagag

SEQ ID NO: 4061 - DNA, 13 bp, Artificial Sequence
  synthetic sequence
tagagcagatgca

SEQ ID NO: 4062 - DNA, 13 bp, Artificial Sequence
  synthetic sequence
cctcaaatcactc

SEQ ID NO: 4063 - DNA, 13 bp, Artificial Sequence
  synthetic sequence
gaaatacttgaaa

SEQ ID NO: 4064 - DNA, 13 bp, Artificial Sequence
  synthetic sequence
gagtaggaggacc

SEQ ID NO: 4065 - DNA, 13 bp, Artificial Sequence
  synthetic sequence
atcagcaaatcct

SEQ ID NO: 4066 - DNA, 13 bp, Artificial Sequence
  synthetic sequence
aatatagtgacag

SEQ ID NO: 4067 - DNA, 13 bp, Artificial Sequence
  synthetic sequence
cagacaataccaa

SEQ ID NO: 4068 - DNA, 13 bp, Artificial Sequence
  synthetic sequence
ctaaaactgcttg

SEQ ID NO: 4069 - DNA, 13 bp, Artificial Sequence
  synthetic sequence
agtaaggatgtat

SEQ ID NO: 4070 - DNA, 13 bp, Artificial Sequence
  synthetic sequence
aggaggaaacatg

SEQ ID NO: 4071 - DNA, 13 bp, Artificial Sequence
  synthetic sequence
cctatagtacaga

SEQ ID NO: 4072 - DNA, 13 bp, Artificial Sequence
  synthetic sequence
tgtgctcctgctg

SEQ ID NO: 4073 - DNA, 13 bp, Artificial Sequence
  synthetic sequence
ttctactgtaata

SEQ ID NO: 4074 - DNA, 13 bp, Artificial Sequence
  synthetic sequence
tgaaatgtaatga

SEQ ID NO: 4075 - DNA, 13 bp, Artificial Sequence
  synthetic sequence
aagctgaacacct

SEQ ID NO: 4076 - DNA, 13 bp, Artificial Sequence
  synthetic sequence
tatagattgataa

SEQ ID NO: 4077 - DNA, 13 bp, Artificial Sequence
  synthetic sequence
acatttagaccaa

SEQ ID NO: 4078 - DNA, 13 bp, Artificial Sequence
  synthetic sequence
tctataacactta

SEQ ID NO: 4079 - DNA, 13 bp, Artificial Sequence
  synthetic sequence
agcagtgggttcc

SEQ ID NO: 4080 - DNA, 13 bp, Artificial Sequence
  synthetic sequence
ttcttcctgccat

SEQ ID NO: 4081 - DNA, 13 bp, Artificial Sequence
  synthetic sequence
cattgacagtcca

SEQ ID NO: 4082 - DNA, 13 bp, Artificial Sequence
  synthetic sequence
ccctgcctaactc

SEQ ID NO: 4083 - DNA, 13 bp, Artificial Sequence
  synthetic sequence
tcaggaatccagg

SEQ ID NO: 4084 - DNA, 13 bp, Artificial Sequence
  synthetic sequence
gctattatgtcta

SEQ ID NO: 4085 - DNA, 13 bp, Artificial Sequence
  synthetic sequence
tctgtgggtacac

SEQ ID NO: 4086 - DNA, 13 bp, Artificial Sequence
  synthetic sequence
tctgataatgctg

SEQ ID NO: 4087 - DNA, 13 bp, Artificial Sequence
  synthetic sequence
ttccagggctcta

SEQ ID NO: 4088 - DNA, 13 bp, Artificial Sequence
  synthetic sequence
ttgcctggagctg

SEQ ID NO: 4089 - DNA, 13 bp, Artificial Sequence
  synthetic sequence
accccaatatgtt

SEQ ID NO: 4090 - DNA, 13 bp, Artificial Sequence
  synthetic sequence
cactggctacatg

SEQ ID NO: 4091 - DNA, 13 bp, Artificial Sequence
  synthetic sequence
aaaaatatgcatc

SEQ ID NO: 4092 - DNA, 13 bp, Artificial Sequence
  synthetic sequence
tttgatgggtcat

SEQ ID NO: 4093 - DNA, 13 bp, Artificial Sequence
  synthetic sequence
ggtggtagctgaa

SEQ ID NO: 4094 - DNA, 13 bp, Artificial Sequence
  synthetic sequence
actgtacctatag

SEQ ID NO: 4095 - DNA, 13 bp, Artificial Sequence
  synthetic sequence
tatgtcctgcttg

SEQ ID NO: 4096 - DNA, 13 bp, Artificial Sequence
  synthetic sequence
ttttgaccacttg

SEQ ID NO: 4097 - DNA, 13 bp, Artificial Sequence
  synthetic sequence
cttttcttcttgg

SEQ ID NO: 4098 - DNA, 13 bp, Artificial Sequence
  synthetic sequence
tgtcagcagtctt

SEQ ID NO: 4099 - DNA, 13 bp, Artificial Sequence
  synthetic sequence
tacaatctgggtt

SEQ ID NO: 4100 - DNA, 13 bp, Artificial Sequence
  synthetic sequence
tgtcaaacttcca

SEQ ID NO: 4101 - DNA, 13 bp, Artificial Sequence
  synthetic sequence
atccaggtcatgt

SEQ ID NO: 4102 - DNA, 13 bp, Artificial Sequence
  synthetic sequence
actgggataggtg

SEQ ID NO: 4103 - DNA, 13 bp, Artificial Sequence
  synthetic sequence
gtctaacagcttc

SEQ ID NO: 4104 - DNA, 13 bp, Artificial Sequence
  synthetic sequence
tcccctcctgagg

SEQ ID NO: 4105 - DNA, 13 bp, Artificial Sequence
  synthetic sequence
cttctttgccaca

SEQ ID NO: 4106 - DNA, 13 bp, Artificial Sequence
  synthetic sequence
tatctattccatc

SEQ ID NO: 4107 - DNA, 13 bp, Artificial Sequence
  synthetic sequence
ctgccatttaaca

SEQ ID NO: 4108 - DNA, 13 bp, Artificial Sequence
  synthetic sequence
atgtattgataga

SEQ ID NO: 4109 - DNA, 13 bp, Artificial Sequence
  synthetic sequence
ccagagagctccc

SEQ ID NO: 4110 - DNA, 13 bp, Artificial Sequence
  synthetic sequence
aaattccctggcc

SEQ ID NO: 4111 - DNA, 13 bp, Artificial Sequence
  synthetic sequence
acaactattgcta

SEQ ID NO: 4112 - DNA, 13 bp, Artificial Sequence
  synthetic sequence
atcctgaatcctg

SEQ ID NO: 4113 - DNA, 13 bp, Artificial Sequence
  synthetic sequence
ccatctcttgtta

SEQ ID NO: 4114 - DNA, 13 bp, Artificial Sequence
  synthetic sequence
gtcctggtcctat

SEQ ID NO: 4115 - DNA, 13 bp, Artificial Sequence
  synthetic sequence
ccacagatcaagg

SEQ ID NO: 4116 - DNA, 13 bp, Artificial Sequence
  synthetic sequence
tctgagggatctc

SEQ ID NO: 4117 - DNA, 13 bp, Artificial Sequence
  synthetic sequence
gctgcttatatgc

SEQ ID NO: 4118 - DNA, 13 bp, Artificial Sequence
  synthetic sequence
ataaccctatctg

SEQ ID NO: 4119 - DNA, 13 bp, Artificial Sequence
  synthetic sequence
ataatcctatctg

SEQ ID NO: 4120 - DNA, 13 bp, Artificial Sequence
  synthetic sequence
gtactatatcaag

SEQ ID NO: 4121 - DNA, 13 bp, Artificial Sequence
  synthetic sequence
gcggaaagtccct

SEQ ID NO: 4122 - DNA, 13 bp, Artificial Sequence
  synthetic sequence
tgccacagttgaa

SEQ ID NO: 4123 - DNA, 13 bp, Artificial Sequence
  synthetic sequence
ctaaagggctcta

SEQ ID NO: 4124 - DNA, 13 bp, Artificial Sequence
  synthetic sequence
atcccaaggagca

SEQ ID NO: 4125 - DNA, 13 bp, Artificial Sequence
  synthetic sequence
gtctgacagcttc

SEQ ID NO: 4126 - DNA, 13 bp, Artificial Sequence
  synthetic sequence
ccatctaaaaata

SEQ ID NO: 4127 - DNA, 13 bp, Artificial Sequence
  synthetic sequence
gtcatccatgcta

SEQ ID NO: 4128 - DNA, 13 bp, Artificial Sequence
  synthetic sequence
atttttccttcct

SEQ ID NO: 4129 - DNA, 13 bp, Artificial Sequence
  synthetic sequence
agccttgtgtgtg

SEQ ID NO: 4130 - DNA, 13 bp, Artificial Sequence
  synthetic sequence
ctaccatttaaca

SEQ ID NO: 4131 - DNA, 13 bp, Artificial Sequence
  synthetic sequence
tggttgtagctgt

SEQ ID NO: 4132 - DNA, 13 bp, Artificial Sequence
  synthetic sequence
gaattgcttgtaa

SEQ ID NO: 4133 - DNA, 13 bp, Artificial Sequence
  synthetic sequence
ctttttcttgtat

SEQ ID NO: 4134 - DNA, 13 bp, Artificial Sequence
  synthetic sequence
gaagaggcacagg

SEQ ID NO: 4135 - DNA, 13 bp, Artificial Sequence
  synthetic sequence
gtactacctttat

SEQ ID NO: 4136 - DNA, 13 bp, Artificial Sequence
  synthetic sequence
ctgctaccaggat

SEQ ID NO: 4137 - DNA, 13 bp, Artificial Sequence
  synthetic sequence
ctggattcgcatt

SEQ ID NO: 4138 - DNA, 13 bp, Artificial Sequence
  synthetic sequence
ctggcctcccctt

SEQ ID NO: 4139 - DNA, 13 bp, Artificial Sequence
  synthetic sequence
taattgctaattt

SEQ ID NO: 4140 - DNA, 13 bp, Artificial Sequence
  synthetic sequence
tcaagtttataaa

SEQ ID NO: 4141 - DNA, 13 bp, Artificial Sequence
  synthetic sequence
tccaaaagcctaa

SEQ ID NO: 4142 - DNA, 13 bp, Artificial Sequence
  synthetic sequence
tagccactcccca

SEQ ID NO: 4143 - DNA, 13 bp, Artificial Sequence
  synthetic sequence
ttaatgccccaga

SEQ ID NO: 4144 - DNA, 13 bp, Artificial Sequence
  synthetic sequence
gatcctaccttgt

SEQ ID NO: 4145 - DNA, 13 bp, Artificial Sequence
  synthetic sequence
ccacaaatttcta

SEQ ID NO: 4146 - DNA, 13 bp, Artificial Sequence
  synthetic sequence
ctatagtccacac

SEQ ID NO: 4147 - DNA, 13 bp, Artificial Sequence
  synthetic sequence
tgtatttctgcta

SEQ ID NO: 4148 - DNA, 13 bp, Artificial Sequence
  synthetic sequence
agagacccagtac

SEQ ID NO: 4149 - DNA, 13 bp, Artificial Sequence
  synthetic sequence
ctatggtccacac

SEQ ID NO: 4150 - DNA, 13 bp, Artificial Sequence
  synthetic sequence
agtactccggatg

SEQ ID NO: 4151 - DNA, 13 bp, Artificial Sequence
  synthetic sequence
cctgtaatatttg

SEQ ID NO: 4152 - DNA, 13 bp, Artificial Sequence
  synthetic sequence
tcttgtggggtgg

SEQ ID NO: 4153 - DNA, 13 bp, Artificial Sequence
  synthetic sequence
atcaccaacccaa

SEQ ID NO: 4154 - DNA, 13 bp, Artificial Sequence
  synthetic sequence
tagcctccgctag

SEQ ID NO: 4155 - DNA, 13 bp, Artificial Sequence
  synthetic sequence
tctcctcctgagg

SEQ ID NO: 4156 - DNA, 13 bp, Artificial Sequence
  synthetic sequence
ttttgaccatttg

SEQ ID NO: 4157 - DNA, 13 bp, Artificial Sequence
  synthetic sequence
tcaaggatctctt

SEQ ID NO: 4158 - DNA, 13 bp, Artificial Sequence
  synthetic sequence
tgtatgtctgttg

SEQ ID NO: 4159 - DNA, 13 bp, Artificial Sequence
  synthetic sequence
cacaattgaaaca

SEQ ID NO: 4160 - DNA, 13 bp, Artificial Sequence
  synthetic sequence
ggccttcccttgt

SEQ ID NO: 4161 - DNA, 13 bp, Artificial Sequence
  synthetic sequence
gattctactactc

SEQ ID NO: 4162 - DNA, 13 bp, Artificial Sequence
  synthetic sequence
gtggcttgccaat

SEQ ID NO: 4163 - DNA, 13 bp, Artificial Sequence
  synthetic sequence
ctagactgccatt

SEQ ID NO: 4164 - DNA, 13 bp, Artificial Sequence
  synthetic sequence
gtcatccatccta

SEQ ID NO: 4165 - DNA, 13 bp, Artificial Sequence
  synthetic sequence
taggatctactgg

SEQ ID NO: 4166 - DNA, 13 bp, Artificial Sequence
  synthetic sequence
tatctatcccatc

SEQ ID NO: 4167 - DNA, 13 bp, Artificial Sequence
  synthetic sequence
ctggtgtgtagtt

SEQ ID NO: 4168 - DNA, 13 bp, Artificial Sequence
  synthetic sequence
cagctgctgcctg

SEQ ID NO: 4169 - DNA, 13 bp, Artificial Sequence
  synthetic sequence
ggcaagctttatt

SEQ ID NO: 4170 - DNA, 13 bp, Artificial Sequence
  synthetic sequence
tgtaattcagtct

SEQ ID NO: 4171 - DNA, 13 bp, Artificial Sequence
  synthetic sequence
gcatcacccacat

SEQ ID NO: 4172 - DNA, 13 bp, Artificial Sequence
  synthetic sequence
cccctcagctact

SEQ ID NO: 4173 - DNA, 13 bp, Artificial Sequence
  synthetic sequence
tctctctgcacca

SEQ ID NO: 4174 - DNA, 13 bp, Artificial Sequence
  synthetic sequence
aaaaactattctt

SEQ ID NO: 4175 - DNA, 13 bp, Artificial Sequence
  synthetic sequence
tctggatttgcat

SEQ ID NO: 4176 - DNA, 13 bp, Artificial Sequence
  synthetic sequence
cctgtgatatttg

SEQ ID NO: 4177 - DNA, 13 bp, Artificial Sequence
  synthetic sequence
gtgggttggggtc

SEQ ID NO: 4178 - DNA, 13 bp, Artificial Sequence
  synthetic sequence
cagccttctgatg

SEQ ID NO: 4179 - DNA, 13 bp, Artificial Sequence
  synthetic sequence
ccctggtcctata

SEQ ID NO: 4180 - DNA, 13 bp, Artificial Sequence
  synthetic sequence
tctgctgtttcta

SEQ ID NO: 4181 - DNA, 13 bp, Artificial Sequence
  synthetic sequence
agccttgtgtgtt

SEQ ID NO: 4182 - DNA, 13 bp, Artificial Sequence
  synthetic sequence
ccaccactcttct

SEQ ID NO: 4183 - DNA, 13 bp, Artificial Sequence
  synthetic sequence
tggtactacatca

SEQ ID NO: 4184 - DNA, 13 bp, Artificial Sequence
  synthetic sequence
gttttctaaaagg

SEQ ID NO: 4185 - DNA, 13 bp, Artificial Sequence
  synthetic sequence
cataatccctaat

SEQ ID NO: 4186 - DNA, 13 bp, Artificial Sequence
  synthetic sequence
gtgcaatttaaag

SEQ ID NO: 4187 - DNA, 13 bp, Artificial Sequence
  synthetic sequence
ctgtcaaatctcc

SEQ ID NO: 4188 - DNA, 13 bp, Artificial Sequence
  synthetic sequence
tctaggtcccctc

SEQ ID NO: 4189 - DNA, 13 bp, Artificial Sequence
  synthetic sequence
tctgttccttcag

SEQ ID NO: 4190 - DNA, 13 bp, Artificial Sequence
  synthetic sequence
ctagtgggatgtg

SEQ ID NO: 4191 - DNA, 13 bp, Artificial Sequence
  synthetic sequence
gcctaggaaaatg

SEQ ID NO: 4192 - DNA, 13 bp, Artificial Sequence
  synthetic sequence
tcagcagtctttg

SEQ ID NO: 4193 - DNA, 13 bp, Artificial Sequence
  synthetic sequence
gtaactcagtctt

SEQ ID NO: 4194 - DNA, 13 bp, Artificial Sequence
  synthetic sequence
gatcctaccttat

SEQ ID NO: 4195 - DNA, 13 bp, Artificial Sequence
  synthetic sequence
attccaaggagca

SEQ ID NO: 4196 - DNA, 13 bp, Artificial Sequence
  synthetic sequence
cccactgcatcca

SEQ ID NO: 4197 - DNA, 13 bp, Artificial Sequence
  synthetic sequence
gtacaatttaaag

SEQ ID NO: 4198 - DNA, 13 bp, Artificial Sequence
  synthetic sequence
ctggaaagtcccc

SEQ ID NO: 4199 - DNA, 13 bp, Artificial Sequence
  synthetic sequence
tggaaggccaaat

SEQ ID NO: 4200 - DNA, 13 bp, Artificial Sequence
  synthetic sequence
caatatgttttta

SEQ ID NO: 4201 - DNA, 13 bp, Artificial Sequence
  synthetic sequence
cctgaatcttgca

SEQ ID NO: 4202 - DNA, 13 bp, Artificial Sequence
  synthetic sequence
aaaagtgcatatt

SEQ ID NO: 4203 - DNA, 13 bp, Artificial Sequence
  synthetic sequence
catcccccacatc

SEQ ID NO: 4204 - DNA, 13 bp, Artificial Sequence
  synthetic sequence
ttaaaaagtggct

SEQ ID NO: 4205 - DNA, 13 bp, Artificial Sequence
  synthetic sequence
tctgggtcccctc

SEQ ID NO: 4206 - DNA, 13 bp, Artificial Sequence
  synthetic sequence
atgcttttaaaat

SEQ ID NO: 4207 - DNA, 13 bp, Artificial Sequence
  synthetic sequence
caatttttgaaat

SEQ ID NO: 4208 - DNA, 13 bp, Artificial Sequence
  synthetic sequence
ttctttcccttac

SEQ ID NO: 4209 - DNA, 13 bp, Artificial Sequence
  synthetic sequence
ggagtgtgatagt

SEQ ID NO: 4210 - DNA, 13 bp, Artificial Sequence
  synthetic sequence
gtgattgctccat

SEQ ID NO: 4211 - DNA, 13 bp, Artificial Sequence
  synthetic sequence
ttcagatctaatt

SEQ ID NO: 4212 - DNA, 13 bp, Artificial Sequence
  synthetic sequence
tttctcccactgg

SEQ ID NO: 4213 - DNA, 13 bp, Artificial Sequence
  synthetic sequence
ttctgtgtcagca

SEQ ID NO: 4214 - DNA, 13 bp, Artificial Sequence
  synthetic sequence
ccttgtttctgta

SEQ ID NO: 4215 - DNA, 13 bp, Artificial Sequence
  synthetic sequence
ccacagatttcta

SEQ ID NO: 4216 - DNA, 13 bp, Artificial Sequence
  synthetic sequence
ggagtgtgatatt

SEQ ID NO: 4217 - DNA, 13 bp, Artificial Sequence
  synthetic sequence
ggaagtatgatag

SEQ ID NO: 4218 - DNA, 13 bp, Artificial Sequence
  synthetic sequence
ctatttctggatt

SEQ ID NO: 4219 - DNA, 13 bp, Artificial Sequence
  synthetic sequence
ctctatctgtcca

SEQ ID NO: 4220 - DNA, 13 bp, Artificial Sequence
  synthetic sequence
ccttgtgtattat

SEQ ID NO: 4221 - DNA, 13 bp, Artificial Sequence
  synthetic sequence
tctttatcccatt

SEQ ID NO: 4222 - DNA, 13 bp, Artificial Sequence
  synthetic sequence
gtgcctttttctt

SEQ ID NO: 4223 - DNA, 13 bp, Artificial Sequence
  synthetic sequence
cggctcctgcttc

SEQ ID NO: 4224 - DNA, 13 bp, Artificial Sequence
  synthetic sequence
caagtctataaaa

SEQ ID NO: 4225 - DNA, 13 bp, Artificial Sequence
  synthetic sequence
aaaaatatgcgtc

SEQ ID NO: 4226 - DNA, 13 bp, Artificial Sequence
  synthetic sequence
acaattattgcta

SEQ ID NO: 4227 - DNA, 13 bp, Artificial Sequence
  synthetic sequence
ggagtgtgattgt

SEQ ID NO: 4228 - DNA, 13 bp, Artificial Sequence
  synthetic sequence
aggcggctgtcaa

SEQ ID NO: 4229 - DNA, 13 bp, Artificial Sequence
  synthetic sequence
actttcctgattc

SEQ ID NO: 4230 - DNA, 13 bp, Artificial Sequence
  synthetic sequence
tcccactccatcc

SEQ ID NO: 4231 - DNA, 13 bp, Artificial Sequence
  synthetic sequence
ccccagactgtga

SEQ ID NO: 4232 - DNA, 13 bp, Artificial Sequence
  synthetic sequence
aaagtgacacaga

SEQ ID NO: 4233 - DNA, 13 bp, Artificial Sequence
  synthetic sequence
ctatctgttccct

SEQ ID NO: 4234 - DNA, 13 bp, Artificial Sequence
  synthetic sequence
aggctgctgtcaa

SEQ ID NO: 4235 - DNA, 13 bp, Artificial Sequence
  synthetic sequence
cctgtaatgtttg

SEQ ID NO: 4236 - DNA, 13 bp, Artificial Sequence
  synthetic sequence
ccatctccacaag

SEQ ID NO: 4237 - DNA, 13 bp, Artificial Sequence
  synthetic sequence
ttggtactacttt

SEQ ID NO: 4238 - DNA, 13 bp, Artificial Sequence
  synthetic sequence
tgttgcataaaat

SEQ ID NO: 4239 - DNA, 13 bp, Artificial Sequence
  synthetic sequence
ttgttttgttctt

SEQ ID NO: 4240 - DNA, 13 bp, Artificial Sequence
  synthetic sequence
ttgttgacatcct

SEQ ID NO: 4241 - DNA, 13 bp, Artificial Sequence
  synthetic sequence
tcaagcttataaa

SEQ ID NO: 4242 - DNA, 13 bp, Artificial Sequence
  synthetic sequence
ggagagttatagt

SEQ ID NO: 4243 - DNA, 13 bp, Artificial Sequence
  synthetic sequence
ccccatctccata

SEQ ID NO: 4244 - DNA, 13 bp, Artificial Sequence
  synthetic sequence
agcaaaaattatt

SEQ ID NO: 4245 - DNA, 13 bp, Artificial Sequence
  synthetic sequence
ccaggcacaatca

SEQ ID NO: 4246 - DNA, 13 bp, Artificial Sequence
  synthetic sequence
ctaggaaagtgtc

SEQ ID NO: 4247 - DNA, 13 bp, Artificial Sequence
  synthetic sequence
tccggatgtagct

SEQ ID NO: 4248 - DNA, 13 bp, Artificial Sequence
  synthetic sequence
cctgccaatactc

SEQ ID NO: 4249 - DNA, 13 bp, Artificial Sequence
  synthetic sequence
ttattcatagatt

SEQ ID NO: 4250 - DNA, 13 bp, Artificial Sequence
  synthetic sequence
ggtctgctctgaa

SEQ ID NO: 4251 - DNA, 13 bp, Artificial Sequence
  synthetic sequence
aaagattattgtt

SEQ ID NO: 4252 - DNA, 13 bp, Artificial Sequence
  synthetic sequence
ctgggttcgcatt

SEQ ID NO: 4253 - DNA, 13 bp, Artificial Sequence
  synthetic sequence
ccctgtttctgta

SEQ ID NO: 4254 - DNA, 13 bp, Artificial Sequence
  synthetic sequence
tgtatgggaattg

SEQ ID NO: 4255 - DNA, 13 bp, Artificial Sequence
  synthetic sequence
gtaagtctctcaa

SEQ ID NO: 4256 - DNA, 13 bp, Artificial Sequence
  synthetic sequence
ggatggttccagg

SEQ ID NO: 4257 - DNA, 13 bp, Artificial Sequence
  synthetic sequence
agacgggcacaca

SEQ ID NO: 4258 - DNA, 13 bp, Artificial Sequence
  synthetic sequence
tcttgtcttttct

SEQ ID NO: 4259 - DNA, 13 bp, Artificial Sequence
  synthetic sequence
tatgtcctgctgg

SEQ ID NO: 4260 - DNA, 13 bp, Artificial Sequence
  synthetic sequence
cttccttgccaca

SEQ ID NO: 4261 - DNA, 13 bp, Artificial Sequence
  synthetic sequence
atgaagtctctca

SEQ ID NO: 4262 - DNA, 13 bp, Artificial Sequence
  synthetic sequence
ccactgctctttt

SEQ ID NO: 4263 - DNA, 13 bp, Artificial Sequence
  synthetic sequence
tatggctgctatg

SEQ ID NO: 4264 - DNA, 13 bp, Artificial Sequence
  synthetic sequence
ctgctcctactcc

SEQ ID NO: 4265 - DNA, 13 bp, Artificial Sequence
  synthetic sequence
tggtactatatca

SEQ ID NO: 4266 - DNA, 13 bp, Artificial Sequence
  synthetic sequence
ggatacagttcct

SEQ ID NO: 4267 - DNA, 13 bp, Artificial Sequence
  synthetic sequence
ctattattctttc

SEQ ID NO: 4268 - DNA, 13 bp, Artificial Sequence
  synthetic sequence
tcttcttctgcta

SEQ ID NO: 4269 - DNA, 13 bp, Artificial Sequence
  synthetic sequence
tcctgcaaagcta

SEQ ID NO: 4270 - DNA, 13 bp, Artificial Sequence
  synthetic sequence
ggccatccaacta

SEQ ID NO: 4271 - DNA, 13 bp, Artificial Sequence
  synthetic sequence
tgtgtcttttgct

SEQ ID NO: 4272 - DNA, 13 bp, Artificial Sequence
  synthetic sequence
ataccttttcttg

SEQ ID NO: 4273 - DNA, 13 bp, Artificial Sequence
  synthetic sequence
taggaaaatgtct

SEQ ID NO: 4274 - DNA, 13 bp, Artificial Sequence
  synthetic sequence
tgccaatcaggga

SEQ ID NO: 4275 - DNA, 13 bp, Artificial Sequence
  synthetic sequence
ggagtgtgatgtt

SEQ ID NO: 4276 - DNA, 13 bp, Artificial Sequence
  synthetic sequence
ctgttaaatctcc

SEQ ID NO: 4277 - DNA, 13 bp, Artificial Sequence
  synthetic sequence
aatagtagtcctg

SEQ ID NO: 4278 - DNA, 13 bp, Artificial Sequence
  synthetic sequence
tcagcagttcttg

SEQ ID NO: 4279 - DNA, 13 bp, Artificial Sequence
  synthetic sequence
ggagtgtgatggt

SEQ ID NO: 4280 - DNA, 13 bp, Artificial Sequence
  synthetic sequence
gtcacattttcca

SEQ ID NO: 4281 - DNA, 13 bp, Artificial Sequence
  synthetic sequence
ccatttccacaag

SEQ ID NO: 4282 - DNA, 13 bp, Artificial Sequence
  synthetic sequence
tcagcagtccttg

SEQ ID NO: 4283 - DNA, 13 bp, Artificial Sequence
  synthetic sequence
tagatctcctcct

SEQ ID NO: 4284 - DNA, 13 bp, Artificial Sequence
  synthetic sequence
atgtctcccactg

SEQ ID NO: 4285 - DNA, 13 bp, Artificial Sequence
  synthetic sequence
ctacaatttaaag

SEQ ID NO: 4286 - DNA, 13 bp, Artificial Sequence
  synthetic sequence
tgatagtgtcatt

SEQ ID NO: 4287 - DNA, 13 bp, Artificial Sequence
  synthetic sequence
actgtccctatag

SEQ ID NO: 4288 - DNA, 13 bp, Artificial Sequence
  synthetic sequence
cactagctacatg

SEQ ID NO: 4289 - DNA, 13 bp, Artificial Sequence
  synthetic sequence
acttgttcttgta

SEQ ID NO: 4290 - DNA, 13 bp, Artificial Sequence
  synthetic sequence
attaatatcccca

SEQ ID NO: 4291 - DNA, 13 bp, Artificial Sequence
  synthetic sequence
gtcctatttctat

SEQ ID NO: 4292 - DNA, 13 bp, Artificial Sequence
  synthetic sequence
cttccttttccat

SEQ ID NO: 4293 - DNA, 13 bp, Artificial Sequence
  synthetic sequence
tctgctcctgctt

SEQ ID NO: 4294 - DNA, 13 bp, Artificial Sequence
  synthetic sequence
gagctcccaggct

SEQ ID NO: 4295 - DNA, 13 bp, Artificial Sequence
  synthetic sequence
cctaatgggatgt

SEQ ID NO: 4296 - DNA, 13 bp, Artificial Sequence
  synthetic sequence
acttcttcttgta

SEQ ID NO: 4297 - DNA, 13 bp, Artificial Sequence
  synthetic sequence
ctagggaaatgtc

SEQ ID NO: 4298 - DNA, 13 bp, Artificial Sequence
  synthetic sequence
catggtgtttaaa

SEQ ID NO: 4299 - DNA, 13 bp, Artificial Sequence
  synthetic sequence
tatgtctggattt

SEQ ID NO: 4300 - DNA, 13 bp, Artificial Sequence
  synthetic sequence
ccaactgctcttt

SEQ ID NO: 4301 - DNA, 13 bp, Artificial Sequence
  synthetic sequence
gcacacactgctt

SEQ ID NO: 4302 - DNA, 13 bp, Artificial Sequence
  synthetic sequence
ttatttgtttaca

SEQ ID NO: 4303 - DNA, 13 bp, Artificial Sequence
  synthetic sequence
ctaacttctgtat

SEQ ID NO: 4304 - DNA, 13 bp, Artificial Sequence
  synthetic sequence
ccccggaaagtcc

SEQ ID NO: 4305 - DNA, 13 bp, Artificial Sequence
  synthetic sequence
taattgtcaattt

SEQ ID NO: 4306 - DNA, 13 bp, Artificial Sequence
  synthetic sequence
ggcctccccttgt

SEQ ID NO: 4307 - DNA, 13 bp, Artificial Sequence
  synthetic sequence
ggagagttatatt

SEQ ID NO: 4308 - DNA, 13 bp, Artificial Sequence
  synthetic sequence
cagcatctgaggg

SEQ ID NO: 4309 - DNA, 13 bp, Artificial Sequence
  synthetic sequence
aggccatcccact

SEQ ID NO: 4310 - DNA, 13 bp, Artificial Sequence
  synthetic sequence
tatccaccattgt

SEQ ID NO: 4311 - DNA, 13 bp, Artificial Sequence
  synthetic sequence
ttatctatgccat

SEQ ID NO: 4312 - DNA, 13 bp, Artificial Sequence
  synthetic sequence
gtataggaattgg

SEQ ID NO: 4313 - DNA, 13 bp, Artificial Sequence
  synthetic sequence
ttctttcccttat

SEQ ID NO: 4314 - DNA, 13 bp, Artificial Sequence
  synthetic sequence
atttgtctacagc

SEQ ID NO: 4315 - DNA, 13 bp, Artificial Sequence
  synthetic sequence
tttgtactacatc

SEQ ID NO: 4316 - DNA, 13 bp, Artificial Sequence
  synthetic sequence
ttgctcttatttt

SEQ ID NO: 4317 - DNA, 13 bp, Artificial Sequence
  synthetic sequence
aggttaggatcta

SEQ ID NO: 4318 - DNA, 13 bp, Artificial Sequence
  synthetic sequence
ccagagagctctc

SEQ ID NO: 4319 - DNA, 13 bp, Artificial Sequence
  synthetic sequence
ggaactgagaaat

SEQ ID NO: 4320 - DNA, 13 bp, Artificial Sequence
  synthetic sequence
actactccttgac

SEQ ID NO: 4321 - DNA, 13 bp, Artificial Sequence
  synthetic sequence
ccacagttgaaac

SEQ ID NO: 4322 - DNA, 13 bp, Artificial Sequence
  synthetic sequence
agggatcctacct

SEQ ID NO: 4323 - DNA, 13 bp, Artificial Sequence
  synthetic sequence
tgttgcatagaat

SEQ ID NO: 4324 - DNA, 13 bp, Artificial Sequence
  synthetic sequence
cctgcaaggctag

SEQ ID NO: 4325 - DNA, 13 bp, Artificial Sequence
  synthetic sequence
ctttcctccttgg

SEQ ID NO: 4326 - DNA, 13 bp, Artificial Sequence
  synthetic sequence
tgtagagatccta

SEQ ID NO: 4327 - DNA, 13 bp, Artificial Sequence
  synthetic sequence
ttttgctcttcct

SEQ ID NO: 4328 - DNA, 13 bp, Artificial Sequence
  synthetic sequence
tgcaatctgggtt

SEQ ID NO: 4329 - DNA, 13 bp, Artificial Sequence
  synthetic sequence
tatattgatagat

SEQ ID NO: 4330 - DNA, 13 bp, Artificial Sequence
  synthetic sequence
aaaaagtgcatac

SEQ ID NO: 4331 - DNA, 13 bp, Artificial Sequence
  synthetic sequence
ctgtcaaatttcc

SEQ ID NO: 4332 - DNA, 13 bp, Artificial Sequence
  synthetic sequence
caaggatgtcttg

SEQ ID NO: 4333 - DNA, 13 bp, Artificial Sequence
  synthetic sequence
gtacagtttaaag

SEQ ID NO: 4334 - DNA, 13 bp, Artificial Sequence
  synthetic sequence
tatctgtcccttc

SEQ ID NO: 4335 - DNA, 13 bp, Artificial Sequence
  synthetic sequence
ccccaatatgttc

SEQ ID NO: 4336 - DNA, 13 bp, Artificial Sequence
  synthetic sequence
ctctctcccattc

SEQ ID NO: 4337 - DNA, 13 bp, Artificial Sequence
  synthetic sequence
ttccctgtctttc

SEQ ID NO: 4338 - DNA, 13 bp, Artificial Sequence
  synthetic sequence
cacacctcccctg

SEQ ID NO: 4339 - DNA, 13 bp, Artificial Sequence
  synthetic sequence
tgcctaacagctt

SEQ ID NO: 4340 - DNA, 13 bp, Artificial Sequence
  synthetic sequence
ccatctcttgtca

SEQ ID NO: 4341 - DNA, 13 bp, Artificial Sequence
  synthetic sequence
gtattgctacttg

SEQ ID NO: 4342 - DNA, 13 bp, Artificial Sequence
  synthetic sequence
tctcctactggga

SEQ ID NO: 4343 - DNA, 13 bp, Artificial Sequence
  synthetic sequence
ggcactactttta

SEQ ID NO: 4344 - DNA, 13 bp, Artificial Sequence
  synthetic sequence
tgatagtgccatt

SEQ ID NO: 4345 - DNA, 13 bp, Artificial Sequence
  synthetic sequence
caaggatatcttg

SEQ ID NO: 4346 - DNA, 13 bp, Artificial Sequence
  synthetic sequence
ctctccctggtcc

SEQ ID NO: 4347 - DNA, 13 bp, Artificial Sequence
  synthetic sequence
taaaactccggat

SEQ ID NO: 4348 - DNA, 13 bp, Artificial Sequence
  synthetic sequence
acaaatttctgtt

SEQ ID NO: 4349 - DNA, 13 bp, Artificial Sequence
  synthetic sequence
ctgtcaaacctcc

SEQ ID NO: 4350 - DNA, 13 bp, Artificial Sequence
  synthetic sequence
cacaattgaagca

SEQ ID NO: 4351 - DNA, 13 bp, Artificial Sequence
  synthetic sequence
gcggaaagtcccc

SEQ ID NO: 4352 - DNA, 13 bp, Artificial Sequence
  synthetic sequence
ctttgaccacttg

SEQ ID NO: 4353 - DNA, 13 bp, Artificial Sequence
  synthetic sequence
tatagaaaagcgc

SEQ ID NO: 4354 - DNA, 13 bp, Artificial Sequence
  synthetic sequence
ttctgtatatcat

SEQ ID NO: 4355 - DNA, 13 bp, Artificial Sequence
  synthetic sequence
gtggaaagtccct

SEQ ID NO: 4356 - DNA, 13 bp, Artificial Sequence
  synthetic sequence
agccaggcacaag

SEQ ID NO: 4357 - DNA, 13 bp, Artificial Sequence
  synthetic sequence
cctgctgtgtttt

SEQ ID NO: 4358 - DNA, 13 bp, Artificial Sequence
  synthetic sequence
ctactgctctttt

SEQ ID NO: 4359 - DNA, 13 bp, Artificial Sequence
  synthetic sequence
tgtcaaactgcca

SEQ ID NO: 4360 - DNA, 13 bp, Artificial Sequence
  synthetic sequence
aaatttcctggcc

SEQ ID NO: 4361 - DNA, 13 bp, Artificial Sequence
  synthetic sequence
tccccaagtgctg

SEQ ID NO: 4362 - DNA, 13 bp, Artificial Sequence
  synthetic sequence
tctctatcccatt

SEQ ID NO: 4363 - DNA, 13 bp, Artificial Sequence
  synthetic sequence
ctttaatacttct

SEQ ID NO: 4364 - DNA, 13 bp, Artificial Sequence
  synthetic sequence
tgttattactaat

SEQ ID NO: 4365 - DNA, 13 bp, Artificial Sequence
  synthetic sequence
cctgccaatagtc

SEQ ID NO: 4366 - DNA, 13 bp, Artificial Sequence
  synthetic sequence
aaataagcatctc

SEQ ID NO: 4367 - DNA, 13 bp, Artificial Sequence
  synthetic sequence
ctatatatccact

SEQ ID NO: 4368 - DNA, 13 bp, Artificial Sequence
  synthetic sequence
ccctatctgtcca

SEQ ID NO: 4369 - DNA, 13 bp, Artificial Sequence
  synthetic sequence
gtcaaattagcat

SEQ ID NO: 4370 - DNA, 13 bp, Artificial Sequence
  synthetic sequence
tctatatatacta

SEQ ID NO: 4371 - DNA, 13 bp, Artificial Sequence
  synthetic sequence
tcccctcctgagt

SEQ ID NO: 4372 - DNA, 13 bp, Artificial Sequence
  synthetic sequence
gggattgtgatgg

SEQ ID NO: 4373 - DNA, 13 bp, Artificial Sequence
  synthetic sequence
atcagtgcaattt

SEQ ID NO: 4374 - DNA, 13 bp, Artificial Sequence
  synthetic sequence
tccccaagatcat

SEQ ID NO: 4375 - DNA, 13 bp, Artificial Sequence
  synthetic sequence
agttccctggcct

SEQ ID NO: 4376 - DNA, 13 bp, Artificial Sequence
  synthetic sequence
tcaagcctataaa

SEQ ID NO: 4377 - DNA, 13 bp, Artificial Sequence
  synthetic sequence
actgtacctacag

SEQ ID NO: 4378 - DNA, 13 bp, Artificial Sequence
  synthetic sequence
cttctgttgtttc

SEQ ID NO: 4379 - DNA, 13 bp, Artificial Sequence
  synthetic sequence
ttctgagagggag

SEQ ID NO: 4380 - DNA, 13 bp, Artificial Sequence
  synthetic sequence
gttacattttcca

SEQ ID NO: 4381 - DNA, 13 bp, Artificial Sequence
  synthetic sequence
ccctgcttctgta

SEQ ID NO: 4382 - DNA, 13 bp, Artificial Sequence
  synthetic sequence
cttctgctaaact

SEQ ID NO: 4383 - DNA, 13 bp, Artificial Sequence
  synthetic sequence
gggattgtgatgt

SEQ ID NO: 4384 - DNA, 13 bp, Artificial Sequence
  synthetic sequence
atccctgcctaat

SEQ ID NO: 4385 - DNA, 13 bp, Artificial Sequence
  synthetic sequence
tctactggatcca

SEQ ID NO: 4386 - DNA, 13 bp, Artificial Sequence
  synthetic sequence
catatattggtag

SEQ ID NO: 4387 - DNA, 13 bp, Artificial Sequence
  synthetic sequence
attaattcagcct

SEQ ID NO: 4388 - DNA, 13 bp, Artificial Sequence
  synthetic sequence
ccatgtccacaag

SEQ ID NO: 4389 - DNA, 13 bp, Artificial Sequence
  synthetic sequence
ccctacctgacta

SEQ ID NO: 4390 - DNA, 13 bp, Artificial Sequence
  synthetic sequence
tcagtgcagttta

SEQ ID NO: 4391 - DNA, 13 bp, Artificial Sequence
  synthetic sequence
gtattggtagata

SEQ ID NO: 4392 - DNA, 13 bp, Artificial Sequence
  synthetic sequence
ttctatgaatact

SEQ ID NO: 4393 - DNA, 13 bp, Artificial Sequence
  synthetic sequence
ttctgttgtttgt

SEQ ID NO: 4394 - DNA, 13 bp, Artificial Sequence
  synthetic sequence
ccacttgccacat

SEQ ID NO: 4395 - DNA, 13 bp, Artificial Sequence
  synthetic sequence
ttatagtgtcatt

SEQ ID NO: 4396 - DNA, 13 bp, Artificial Sequence
  synthetic sequence
ttggccactcccc

SEQ ID NO: 4397 - DNA, 13 bp, Artificial Sequence
  synthetic sequence
tcctggtcctata

SEQ ID NO: 4398 - DNA, 13 bp, Artificial Sequence
  synthetic sequence
ctacagtttaaag

SEQ ID NO: 4399 - DNA, 13 bp, Artificial Sequence
  synthetic sequence
tgtcagcaatctt

SEQ ID NO: 4400 - DNA, 13 bp, Artificial Sequence
  synthetic sequence
atttttccttctt

SEQ ID NO: 4401 - DNA, 13 bp, Artificial Sequence
  synthetic sequence
ttctttctcttac

SEQ ID NO: 4402 - DNA, 13 bp, Artificial Sequence
  synthetic sequence
ccactggccacat

SEQ ID NO: 4403 - DNA, 13 bp, Artificial Sequence
  synthetic sequence
ctatcaaacttcc

SEQ ID NO: 4404 - DNA, 13 bp, Artificial Sequence
  synthetic sequence
acacagagtgggg

SEQ ID NO: 4405 - DNA, 13 bp, Artificial Sequence
  synthetic sequence
tctattccatcta

SEQ ID NO: 4406 - DNA, 13 bp, Artificial Sequence
  synthetic sequence
tccctgatgctaa

SEQ ID NO: 4407 - DNA, 13 bp, Artificial Sequence
  synthetic sequence
tattcatggattc

SEQ ID NO: 4408 - DNA, 13 bp, Artificial Sequence
  synthetic sequence
tttgtatatcatt

SEQ ID NO: 4409 - DNA, 13 bp, Artificial Sequence
  synthetic sequence
atccttgtgtgtg

SEQ ID NO: 4410 - DNA, 13 bp, Artificial Sequence
  synthetic sequence
tattgtcttatta

SEQ ID NO: 4411 - DNA, 13 bp, Artificial Sequence
  synthetic sequence
agccaggactctt

SEQ ID NO: 4412 - DNA, 13 bp, Artificial Sequence
  synthetic sequence
cctccatcacgtg

SEQ ID NO: 4413 - DNA, 13 bp, Artificial Sequence
  synthetic sequence
atcctaggcaatt

SEQ ID NO: 4414 - DNA, 13 bp, Artificial Sequence
  synthetic sequence
acatataatccca

SEQ ID NO: 4415 - DNA, 13 bp, Artificial Sequence
  synthetic sequence
tttgaaagttgga

SEQ ID NO: 4416 - DNA, 13 bp, Artificial Sequence
  synthetic sequence
ggtgaccatttca

SEQ ID NO: 4417 - DNA, 13 bp, Artificial Sequence
  synthetic sequence
taatcataatcct

SEQ ID NO: 4418 - DNA, 13 bp, Artificial Sequence
  synthetic sequence
aagagctgctggt

SEQ ID NO: 4419 - DNA, 13 bp, Artificial Sequence
  synthetic sequence
ttattgcttcaga

SEQ ID NO: 4420 - DNA, 13 bp, Artificial Sequence
  synthetic sequence
agtgtccttgttg

SEQ ID NO: 4421 - DNA, 13 bp, Artificial Sequence
  synthetic sequence
tcaagatcagata

SEQ ID NO: 4422 - DNA, 13 bp, Artificial Sequence
  synthetic sequence
ttgatgccaacag

SEQ ID NO: 4423 - DNA, 13 bp, Artificial Sequence
  synthetic sequence
ccagttgaattat

SEQ ID NO: 4424 - DNA, 13 bp, Artificial Sequence
  synthetic sequence
acactcacaaaac

SEQ ID NO: 4425 - DNA, 13 bp, Artificial Sequence
  synthetic sequence
agaactcttggca

SEQ ID NO: 4426 - DNA, 13 bp, Artificial Sequence
  synthetic sequence
tcactcatgtagt

SEQ ID NO: 4427 - DNA, 13 bp, Artificial Sequence
  synthetic sequence
gaaacaccaggct

SEQ ID NO: 4428 - DNA, 13 bp, Artificial Sequence
  synthetic sequence
catcataaacatc

SEQ ID NO: 4429 - DNA, 13 bp, Artificial Sequence
  synthetic sequence
tggtttgagaaca

SEQ ID NO: 4430 - DNA, 13 bp, Artificial Sequence
  synthetic sequence
cacatataagaga

SEQ ID NO: 4431 - DNA, 13 bp, Artificial Sequence
  synthetic sequence
ttgactgaatcat

SEQ ID NO: 4432 - DNA, 13 bp, Artificial Sequence
  synthetic sequence
gtaatgatgttgt

SEQ ID NO: 4433 - DNA, 13 bp, Artificial Sequence
  synthetic sequence
aaatcttgatctt

SEQ ID NO: 4434 - DNA, 13 bp, Artificial Sequence
  synthetic sequence
ctagaaattattt

SEQ ID NO: 4435 - DNA, 13 bp, Artificial Sequence
  synthetic sequence
agaaatcttcaag

SEQ ID NO: 4436 - DNA, 13 bp, Artificial Sequence
  synthetic sequence
ctgcatacaagaa

SEQ ID NO: 4437 - DNA, 13 bp, Artificial Sequence
  synthetic sequence
agtcaatctcaat

SEQ ID NO: 4438 - DNA, 13 bp, Artificial Sequence
  synthetic sequence
gtgaccacttcat

SEQ ID NO: 4439 - DNA, 13 bp, Artificial Sequence
  synthetic sequence
gtcctcttctgaa

SEQ ID NO: 4440 - DNA, 13 bp, Artificial Sequence
  synthetic sequence
acaaatggtctca

SEQ ID NO: 4441 - DNA, 13 bp, Artificial Sequence
  synthetic sequence
tgatcactcatat

SEQ ID NO: 4442 - DNA, 13 bp, Artificial Sequence
  synthetic sequence
tgatcaattgttc

SEQ ID NO: 4443 - DNA, 13 bp, Artificial Sequence
  synthetic sequence
acttaaaacactg

SEQ ID NO: 4444 - DNA, 13 bp, Artificial Sequence
  synthetic sequence
atcatctttgtca

SEQ ID NO: 4445 - DNA, 13 bp, Artificial Sequence
  synthetic sequence
aagaaatcttctg

SEQ ID NO: 4446 - DNA, 13 bp, Artificial Sequence
  synthetic sequence
tctataagtggta

SEQ ID NO: 4447 - DNA, 13 bp, Artificial Sequence
  synthetic sequence
gtctccaacagtc

SEQ ID NO: 4448 - DNA, 13 bp, Artificial Sequence
  synthetic sequence
tcatttattgatg

SEQ ID NO: 4449 - DNA, 13 bp, Artificial Sequence
  synthetic sequence
ccttggtggcatg

SEQ ID NO: 4450 - DNA, 13 bp, Artificial Sequence
  synthetic sequence
tcaaagaaatcct

SEQ ID NO: 4451 - DNA, 13 bp, Artificial Sequence
  synthetic sequence
tattcttggtcca

SEQ ID NO: 4452 - DNA, 13 bp, Artificial Sequence
  synthetic sequence
gcatacaaaaatc

SEQ ID NO: 4453 - DNA, 13 bp, Artificial Sequence
  synthetic sequence
tttttgttgactc

SEQ ID NO: 4454 - DNA, 13 bp, Artificial Sequence
  synthetic sequence
agtcctgcttgtt

SEQ ID NO: 4455 - DNA, 13 bp, Artificial Sequence
  synthetic sequence
tgtataacaggtg

SEQ ID NO: 4456 - DNA, 13 bp, Artificial Sequence
  synthetic sequence
ggtgctcactaga

SEQ ID NO: 4457 - DNA, 13 bp, Artificial Sequence
  synthetic sequence
atcacctccatat

SEQ ID NO: 4458 - DNA, 13 bp, Artificial Sequence
  synthetic sequence
agacttaaggttc

SEQ ID NO: 4459 - DNA, 13 bp, Artificial Sequence
  synthetic sequence
cacatgtaggaaa

SEQ ID NO: 4460 - DNA, 13 bp, Artificial Sequence
  synthetic sequence
acttactataaca

SEQ ID NO: 4461 - DNA, 13 bp, Artificial Sequence
  synthetic sequence
attgtggcgactc

SEQ ID NO: 4462 - DNA, 13 bp, Artificial Sequence
  synthetic sequence
cttctttgcatct

SEQ ID NO: 4463 - DNA, 13 bp, Artificial Sequence
  synthetic sequence
gatgcaatggaac

SEQ ID NO: 4464 - DNA, 13 bp, Artificial Sequence
  synthetic sequence
acttctttgaaac

SEQ ID NO: 4465 - DNA, 13 bp, Artificial Sequence
  synthetic sequence
catttgcgttgca

SEQ ID NO: 4466 - DNA, 13 bp, Artificial Sequence
  synthetic sequence
aatgacacatgta

SEQ ID NO: 4467 - DNA, 13 bp, Artificial Sequence
  synthetic sequence
ccccacttgctgt

SEQ ID NO: 4468 - DNA, 13 bp, Artificial Sequence
  synthetic sequence
ctccagcagtctg

SEQ ID NO: 4469 - DNA, 13 bp, Artificial Sequence
  synthetic sequence
ctgccgtctatca

SEQ ID NO: 4470 - DNA, 13 bp, Artificial Sequence
  synthetic sequence
ttgtattcatagt

SEQ ID NO: 4471 - DNA, 13 bp, Artificial Sequence
  synthetic sequence
tactgtagcagag

SEQ ID NO: 4472 - DNA, 13 bp, Artificial Sequence
  synthetic sequence
gattcttgactgt

SEQ ID NO: 4473 - DNA, 13 bp, Artificial Sequence
  synthetic sequence
gacttgaagcact

SEQ ID NO: 4474 - DNA, 13 bp, Artificial Sequence
  synthetic sequence
ttgttattgatgc

SEQ ID NO: 4475 - DNA, 13 bp, Artificial Sequence
  synthetic sequence
gatcctggtcatg

SEQ ID NO: 4476 - DNA, 13 bp, Artificial Sequence
  synthetic sequence
aaggacttctcct

SEQ ID NO: 4477 - DNA, 13 bp, Artificial Sequence
  synthetic sequence
tggtttccctttt

SEQ ID NO: 4478 - DNA, 13 bp, Artificial Sequence
  synthetic sequence
ctcgtaactgtcc

SEQ ID NO: 4479 - DNA, 13 bp, Artificial Sequence
  synthetic sequence
taaagctttgatt

SEQ ID NO: 4480 - DNA, 13 bp, Artificial Sequence
  synthetic sequence
gcgctgttaccat

SEQ ID NO: 4481 - DNA, 13 bp, Artificial Sequence
  synthetic sequence
actctgaaaggca

SEQ ID NO: 4482 - DNA, 13 bp, Artificial Sequence
  synthetic sequence
aattctagaatgg

SEQ ID NO: 4483 - DNA, 13 bp, Artificial Sequence
  synthetic sequence
tctcctgacaagt

SEQ ID NO: 4484 - DNA, 13 bp, Artificial Sequence
  synthetic sequence
aagtattcaaaga

SEQ ID NO: 4485 - DNA, 13 bp, Artificial Sequence
  synthetic sequence
ttcaagcagctca

SEQ ID NO: 4486 - DNA, 13 bp, Artificial Sequence
  synthetic sequence
aagaagacgtcat

SEQ ID NO: 4487 - DNA, 13 bp, Artificial Sequence
  synthetic sequence
tcttgtagtgaca

SEQ ID NO: 4488 - DNA, 13 bp, Artificial Sequence
  synthetic sequence
agcgttacatagt

SEQ ID NO: 4489 - DNA, 13 bp, Artificial Sequence
  synthetic sequence
agaaacttaatcc

SEQ ID NO: 4490 - DNA, 13 bp, Artificial Sequence
  synthetic sequence
agataaggctatg

SEQ ID NO: 4491 - DNA, 13 bp, Artificial Sequence
  synthetic sequence
tttgagcaataat

SEQ ID NO: 4492 - DNA, 13 bp, Artificial Sequence
  synthetic sequence
tagtgaatccctg

SEQ ID NO: 4493 - DNA, 13 bp, Artificial Sequence
  synthetic sequence
catcattgggccc

SEQ ID NO: 4494 - DNA, 13 bp, Artificial Sequence
  synthetic sequence
aagtcttcagtca

SEQ ID NO: 4495 - DNA, 13 bp, Artificial Sequence
  synthetic sequence
aatcaatctcaat

SEQ ID NO: 4496 - DNA, 13 bp, Artificial Sequence
  synthetic sequence
aaaactaaaatca

SEQ ID NO: 4497 - DNA, 13 bp, Artificial Sequence
  synthetic sequence
tcttgacaatatg

SEQ ID NO: 4498 - DNA, 13 bp, Artificial Sequence
  synthetic sequence
acttaaagcactg

SEQ ID NO: 4499 - DNA, 13 bp, Artificial Sequence
  synthetic sequence
aaactagacacaa

SEQ ID NO: 4500 - DNA, 13 bp, Artificial Sequence
  synthetic sequence
aatgcagatttgt

SEQ ID NO: 4501 - DNA, 13 bp, Artificial Sequence
  synthetic sequence
atttgcctttacg

SEQ ID NO: 4502 - DNA, 13 bp, Artificial Sequence
  synthetic sequence
ttactgtgatcca

SEQ ID NO: 4503 - DNA, 13 bp, Artificial Sequence
  synthetic sequence
tatcattaacact

SEQ ID NO: 4504 - DNA, 13 bp, Artificial Sequence
  synthetic sequence
tggttcgaaaaca

SEQ ID NO: 4505 - DNA, 13 bp, Artificial Sequence
  synthetic sequence
ttagtgaagagag

SEQ ID NO: 4506 - DNA, 13 bp, Artificial Sequence
  synthetic sequence
tcaggtcccactg

SEQ ID NO: 4507 - DNA, 13 bp, Artificial Sequence
  synthetic sequence
tcactcatgtaat

SEQ ID NO: 4508 - DNA, 13 bp, Artificial Sequence
  synthetic sequence
aatcaacctcaat

SEQ ID NO: 4509 - DNA, 13 bp, Artificial Sequence
  synthetic sequence
tggacttcagtgg

SEQ ID NO: 4510 - DNA, 13 bp, Artificial Sequence
  synthetic sequence
tttttgttgattc

SEQ ID NO: 4511 - DNA, 13 bp, Artificial Sequence
  synthetic sequence
gatcttgatcttg

SEQ ID NO: 4512 - DNA, 13 bp, Artificial Sequence
  synthetic sequence
tggcacatgtaag

SEQ ID NO: 4513 - DNA, 13 bp, Artificial Sequence
  synthetic sequence
aatgatgttctcc

SEQ ID NO: 4514 - DNA, 13 bp, Artificial Sequence
  synthetic sequence
tatgtccttgttg

SEQ ID NO: 4515 - DNA, 13 bp, Artificial Sequence
  synthetic sequence
ttgatttactata

SEQ ID NO: 4516 - DNA, 13 bp, Artificial Sequence
  synthetic sequence
cacatgtaatccc

SEQ ID NO: 4517 - DNA, 13 bp, Artificial Sequence
  synthetic sequence
tgtgttcacctga

SEQ ID NO: 4518 - DNA, 13 bp, Artificial Sequence
  synthetic sequence
cacatatagtccc

SEQ ID NO: 4519 - DNA, 13 bp, Artificial Sequence
  synthetic sequence
acctccaacagtc

SEQ ID NO: 4520 - DNA, 13 bp, Artificial Sequence
  synthetic sequence
ccctgatgacaac

SEQ ID NO: 4521 - DNA, 13 bp, Artificial Sequence
  synthetic sequence
tcctccaatgagt

SEQ ID NO: 4522 - DNA, 13 bp, Artificial Sequence
  synthetic sequence
ttgttgagaaggt

SEQ ID NO: 4523 - DNA, 13 bp, Artificial Sequence
  synthetic sequence
ttgagacaccagg

SEQ ID NO: 4524 - DNA, 13 bp, Artificial Sequence
  synthetic sequence
accatcaccttcc

SEQ ID NO: 4525 - DNA, 13 bp, Artificial Sequence
  synthetic sequence
acagatcaactgg

SEQ ID NO: 4526 - DNA, 13 bp, Artificial Sequence
  synthetic sequence
aacttaaggactg

SEQ ID NO: 4527 - DNA, 13 bp, Artificial Sequence
  synthetic sequence
gtaaaggatgcca

SEQ ID NO: 4528 - DNA, 13 bp, Artificial Sequence
  synthetic sequence
catcacaatcaag

SEQ ID NO: 4529 - DNA, 13 bp, Artificial Sequence
  synthetic sequence
aacttgaatctat

SEQ ID NO: 4530 - DNA, 13 bp, Artificial Sequence
  synthetic sequence
aggttcttttctg

SEQ ID NO: 4531 - DNA, 13 bp, Artificial Sequence
  synthetic sequence
gcaatcacttcct

SEQ ID NO: 4532 - DNA, 13 bp, Artificial Sequence
  synthetic sequence
ctgttattgactg

SEQ ID NO: 4533 - DNA, 13 bp, Artificial Sequence
  synthetic sequence
ttgatagcttcag

SEQ ID NO: 4534 - DNA, 13 bp, Artificial Sequence
  synthetic sequence
agaagtcttcaag

SEQ ID NO: 4535 - DNA, 13 bp, Artificial Sequence
  synthetic sequence
taagactgtggtg

SEQ ID NO: 4536 - DNA, 13 bp, Artificial Sequence
  synthetic sequence
tggtttgaaaaca

SEQ ID NO: 4537 - DNA, 13 bp, Artificial Sequence
  synthetic sequence
tatgttcttgttg

SEQ ID NO: 4538 - DNA, 13 bp, Artificial Sequence
  synthetic sequence
tcatataatagtg

SEQ ID NO: 4539 - DNA, 13 bp, Artificial Sequence
  synthetic sequence
caaccaaacctga

SEQ ID NO: 4540 - DNA, 13 bp, Artificial Sequence
  synthetic sequence
acttccatatcaa

SEQ ID NO: 4541 - DNA, 13 bp, Artificial Sequence
  synthetic sequence
aaagaagtcctca

SEQ ID NO: 4542 - DNA, 13 bp, Artificial Sequence
  synthetic sequence
acatatgattcaa

SEQ ID NO: 4543 - DNA, 13 bp, Artificial Sequence
  synthetic sequence
acatgtagtccca

SEQ ID NO: 4544 - DNA, 13 bp, Artificial Sequence
  synthetic sequence
acaacttggtatc

SEQ ID NO: 4545 - DNA, 13 bp, Artificial Sequence
  synthetic sequence
acagatgaacagg

SEQ ID NO: 4546 - DNA, 13 bp, Artificial Sequence
  synthetic sequence
tgaacctattagt

SEQ ID NO: 4547 - DNA, 13 bp, Artificial Sequence
  synthetic sequence
atggtgtaaatgt

SEQ ID NO: 4548 - DNA, 13 bp, Artificial Sequence
  synthetic sequence
ctcacataagact

SEQ ID NO: 4549 - DNA, 13 bp, Artificial Sequence
  synthetic sequence
tgttcacatccat

SEQ ID NO: 4550 - DNA, 13 bp, Artificial Sequence
  synthetic sequence
ctccaacaatctg

SEQ ID NO: 4551 - DNA, 13 bp, Artificial Sequence
  synthetic sequence
atgggaaacaagc

SEQ ID NO: 4552 - DNA, 13 bp, Artificial Sequence
  synthetic sequence
ctatgatccatgc

SEQ ID NO: 4553 - DNA, 13 bp, Artificial Sequence
  synthetic sequence
catacagaaatct

SEQ ID NO: 4554 - DNA, 13 bp, Artificial Sequence
  synthetic sequence
gaatttgattaca

SEQ ID NO: 4555 - DNA, 13 bp, Artificial Sequence
  synthetic sequence
tcatagtcctgtt

SEQ ID NO: 4556 - DNA, 13 bp, Artificial Sequence
  synthetic sequence
atgctatagaact

SEQ ID NO: 4557 - DNA, 13 bp, Artificial Sequence
  synthetic sequence
gctgaactcctcc

SEQ ID NO: 4558 - DNA, 13 bp, Artificial Sequence
  synthetic sequence
tcataatcctgct

SEQ ID NO: 4559 - DNA, 13 bp, Artificial Sequence
  synthetic sequence
cagatggggaaca

SEQ ID NO: 4560 - DNA, 13 bp, Artificial Sequence
  synthetic sequence
tcatctttgttaa

SEQ ID NO: 4561 - DNA, 13 bp, Artificial Sequence
  synthetic sequence
gagtaaaagaagt

SEQ ID NO: 4562 - DNA, 13 bp, Artificial Sequence
  synthetic sequence
tcagatattgagg

SEQ ID NO: 4563 - DNA, 13 bp, Artificial Sequence
  synthetic sequence
ttgatttgctgta

SEQ ID NO: 4564 - DNA, 13 bp, Artificial Sequence
  synthetic sequence
ttacacctcacaa

SEQ ID NO: 4565 - DNA, 13 bp, Artificial Sequence
  synthetic sequence
attgaatcataac

SEQ ID NO: 4566 - DNA, 13 bp, Artificial Sequence
  synthetic sequence
ttgatgccttgat

SEQ ID NO: 4567 - DNA, 13 bp, Artificial Sequence
  synthetic sequence
aagtcttcggtca

SEQ ID NO: 4568 - DNA, 13 bp, Artificial Sequence
  synthetic sequence
actaagatcattt

SEQ ID NO: 4569 - DNA, 13 bp, Artificial Sequence
  synthetic sequence
gctgacttattta

SEQ ID NO: 4570 - DNA, 13 bp, Artificial Sequence
  synthetic sequence
ttctttgagacgc

SEQ ID NO: 4571 - DNA, 13 bp, Artificial Sequence
  synthetic sequence
agagggatgagat

SEQ ID NO: 4572 - DNA, 13 bp, Artificial Sequence
  synthetic sequence
tcctctgtcaagc

SEQ ID NO: 4573 - DNA, 13 bp, Artificial Sequence
  synthetic sequence
aatcataatcttg

SEQ ID NO: 4574 - DNA, 13 bp, Artificial Sequence
  synthetic sequence
acaaacatctcaa

SEQ ID NO: 4575 - DNA, 13 bp, Artificial Sequence
  synthetic sequence
tcataactgttag

SEQ ID NO: 4576 - DNA, 13 bp, Artificial Sequence
  synthetic sequence
attggaaatattc

SEQ ID NO: 4577 - DNA, 13 bp, Artificial Sequence
  synthetic sequence
tcatctagatcat

SEQ ID NO: 4578 - DNA, 13 bp, Artificial Sequence
  synthetic sequence
agaactcttgaca

SEQ ID NO: 4579 - DNA, 13 bp, Artificial Sequence
  synthetic sequence
tgattgcacaaat

SEQ ID NO: 4580 - DNA, 13 bp, Artificial Sequence
  synthetic sequence
gagtaaaagaaat

SEQ ID NO: 4581 - DNA, 13 bp, Artificial Sequence
  synthetic sequence
catacaagaatct

SEQ ID NO: 4582 - DNA, 13 bp, Artificial Sequence
  synthetic sequence
gactcttggctat

SEQ ID NO: 4583 - DNA, 13 bp, Artificial Sequence
  synthetic sequence
ttgcataggtgaa

SEQ ID NO: 4584 - DNA, 13 bp, Artificial Sequence
  synthetic sequence
atcctaggcattt

SEQ ID NO: 4585 - DNA, 13 bp, Artificial Sequence
  synthetic sequence
gtcccaactctca

SEQ ID NO: 4586 - DNA, 13 bp, Artificial Sequence
  synthetic sequence
catcaatcccatg

SEQ ID NO: 4587 - DNA, 13 bp, Artificial Sequence
  synthetic sequence
gtctccaacatgt

SEQ ID NO: 4588 - DNA, 13 bp, Artificial Sequence
  synthetic sequence
tagtgacattctt

SEQ ID NO: 4589 - DNA, 13 bp, Artificial Sequence
  synthetic sequence
acattcacatgga

SEQ ID NO: 4590 - DNA, 13 bp, Artificial Sequence
  synthetic sequence
gacctctttgtgt

SEQ ID NO: 4591 - DNA, 13 bp, Artificial Sequence
  synthetic sequence
tgcatgtggcata

SEQ ID NO: 4592 - DNA, 13 bp, Artificial Sequence
  synthetic sequence
gatgcagccaacc

SEQ ID NO: 4593 - DNA, 13 bp, Artificial Sequence
  synthetic sequence
aacaaagcagtga

SEQ ID NO: 4594 - DNA, 13 bp, Artificial Sequence
  synthetic sequence
tgcatatggcata

SEQ ID NO: 4595 - DNA, 13 bp, Artificial Sequence
  synthetic sequence
tgtggcttcccat

SEQ ID NO: 4596 - DNA, 13 bp, Artificial Sequence
  synthetic sequence
gcatggtgccgaa

SEQ ID NO: 4597 - DNA, 13 bp, Artificial Sequence
  synthetic sequence
aagggaaaacacc

SEQ ID NO: 4598 - DNA, 13 bp, Artificial Sequence
  synthetic sequence
tctgactcgagat

SEQ ID NO: 4599 - DNA, 13 bp, Artificial Sequence
  synthetic sequence
catgccagtgtca

SEQ ID NO: 4600 - DNA, 13 bp, Artificial Sequence
  synthetic sequence
caaagaacaacag

SEQ ID NO: 4601 - DNA, 13 bp, Artificial Sequence
  synthetic sequence
tggactctctctg

SEQ ID NO: 4602 - DNA, 13 bp, Artificial Sequence
  synthetic sequence
catattgccacca

SEQ ID NO: 4603 - DNA, 13 bp, Artificial Sequence
  synthetic sequence
cttataatgaaga

SEQ ID NO: 4604 - DNA, 13 bp, Artificial Sequence
  synthetic sequence
gaaatgagactgg

SEQ ID NO: 4605 - DNA, 13 bp, Artificial Sequence
  synthetic sequence
gctgtagatgcag

SEQ ID NO: 4606 - DNA, 13 bp, Artificial Sequence
  synthetic sequence
actgttgcaaatg

SEQ ID NO: 4607 - DNA, 13 bp, Artificial Sequence
  synthetic sequence
cgcttttagagat

SEQ ID NO: 4608 - DNA, 13 bp, Artificial Sequence
  synthetic sequence
gcaatgagacagg

SEQ ID NO: 4609 - DNA, 13 bp, Artificial Sequence
  synthetic sequence
gggaccattgcca

SEQ ID NO: 4610 - DNA, 13 bp, Artificial Sequence
  synthetic sequence
acaaagcagtaaa

SEQ ID NO: 4611 - DNA, 13 bp, Artificial Sequence
  synthetic sequence
acatcagtcgaag

SEQ ID NO: 4612 - DNA, 13 bp, Artificial Sequence
  synthetic sequence
tttttccaggaag

SEQ ID NO: 4613 - DNA, 13 bp, Artificial Sequence
  synthetic sequence
acatcatggtcgg

SEQ ID NO: 4614 - DNA, 13 bp, Artificial Sequence
  synthetic sequence
agtcatctgaggt

SEQ ID NO: 4615 - DNA, 13 bp, Artificial Sequence
  synthetic sequence
catcaattccatg

SEQ ID NO: 4616 - DNA, 13 bp, Artificial Sequence
  synthetic sequence
agacttggcatgg

SEQ ID NO: 4617 - DNA, 13 bp, Artificial Sequence
  synthetic sequence
ccccatcaagcat

SEQ ID NO: 4618 - DNA, 13 bp, Artificial Sequence
  synthetic sequence
agcatgcaagctc

SEQ ID NO: 4619 - DNA, 13 bp, Artificial Sequence
  synthetic sequence
gatctttttgtct

SEQ ID NO: 4620 - DNA, 13 bp, Artificial Sequence
  synthetic sequence
gcatggtgccaaa

SEQ ID NO: 4621 - DNA, 13 bp, Artificial Sequence
  synthetic sequence
tcttcttttcaac

SEQ ID NO: 4622 - DNA, 13 bp, Artificial Sequence
  synthetic sequence
tctgattccagat

SEQ ID NO: 4623 - DNA, 13 bp, Artificial Sequence
  synthetic sequence
ttgaactgtttta

SEQ ID NO: 4624 - DNA, 13 bp, Artificial Sequence
  synthetic sequence
ggggaagacacca

SEQ ID NO: 4625 - DNA, 13 bp, Artificial Sequence
  synthetic sequence
cctcatgtgatag

SEQ ID NO: 4626 - DNA, 13 bp, Artificial Sequence
  synthetic sequence
catttacatggac

SEQ ID NO: 4627 - DNA, 13 bp, Artificial Sequence
  synthetic sequence
ttgattgtctcta

SEQ ID NO: 4628 - DNA, 13 bp, Artificial Sequence
  synthetic sequence
caaggcagtgaat

SEQ ID NO: 4629 - DNA, 13 bp, Artificial Sequence
  synthetic sequence
cccactttttgtg

SEQ ID NO: 4630 - DNA, 13 bp, Artificial Sequence
  synthetic sequence
gtaatgagacagg

SEQ ID NO: 4631 - DNA, 13 bp, Artificial Sequence
  synthetic sequence
tttaggattgcgc

SEQ ID NO: 4632 - DNA, 13 bp, Artificial Sequence
  synthetic sequence
gcaggtcatctga

SEQ ID NO: 4633 - DNA, 13 bp, Artificial Sequence
  synthetic sequence
tgtgcatgtgaca

SEQ ID NO: 4634 - DNA, 13 bp, Artificial Sequence
  synthetic sequence
cattgtggcacag

SEQ ID NO: 4635 - DNA, 13 bp, Artificial Sequence
  synthetic sequence
agctgatcatgaa

SEQ ID NO: 4636 - DNA, 13 bp, Artificial Sequence
  synthetic sequence
tttttggttgcgc

SEQ ID NO: 4637 - DNA, 13 bp, Artificial Sequence
  synthetic sequence
caaagaacaatag

SEQ ID NO: 4638 - DNA, 13 bp, Artificial Sequence
  synthetic sequence
atagaggaagtga

SEQ ID NO: 4639 - DNA, 13 bp, Artificial Sequence
  synthetic sequence
tctgtggtttccc

SEQ ID NO: 4640 - DNA, 13 bp, Artificial Sequence
  synthetic sequence
tgagtacttagca

SEQ ID NO: 4641 - DNA, 13 bp, Artificial Sequence
  synthetic sequence
catgctagtgtca

SEQ ID NO: 4642 - DNA, 13 bp, Artificial Sequence
  synthetic sequence
tgcatatggcaca

SEQ ID NO: 4643 - DNA, 13 bp, Artificial Sequence
  synthetic sequence
accactgtgggac

SEQ ID NO: 4644 - DNA, 13 bp, Artificial Sequence
  synthetic sequence
gtctccagcatgt

SEQ ID NO: 4645 - DNA, 13 bp, Artificial Sequence
  synthetic sequence
taaatgatcaact

SEQ ID NO: 4646 - DNA, 13 bp, Artificial Sequence
  synthetic sequence
caattcaagtgtc

SEQ ID NO: 4647 - DNA, 13 bp, Artificial Sequence
  synthetic sequence
gtcccaaactgat

SEQ ID NO: 4648 - DNA, 13 bp, Artificial Sequence
  synthetic sequence
ccttcacctggac

SEQ ID NO: 4649 - DNA, 13 bp, Artificial Sequence
  synthetic sequence
atatcatggttgg

SEQ ID NO: 4650 - DNA, 13 bp, Artificial Sequence
  synthetic sequence
agaagaggtgatg

SEQ ID NO: 4651 - DNA, 13 bp, Artificial Sequence
  synthetic sequence
atgctggggatgc

SEQ ID NO: 4652 - DNA, 13 bp, Artificial Sequence
  synthetic sequence
gataaatgaccaa

SEQ ID NO: 4653 - DNA, 13 bp, Artificial Sequence
  synthetic sequence
gtcagacttggca

SEQ ID NO: 4654 - DNA, 13 bp, Artificial Sequence
  synthetic sequence
tgggacaaatagt

SEQ ID NO: 4655 - DNA, 13 bp, Artificial Sequence
  synthetic sequence
attctttcaagaa

SEQ ID NO: 4656 - DNA, 13 bp, Artificial Sequence
  synthetic sequence
atggaggaagaca

SEQ ID NO: 4657 - DNA, 13 bp, Artificial Sequence
  synthetic sequence
tatcaaaagacag

SEQ ID NO: 4658 - DNA, 13 bp, Artificial Sequence
  synthetic sequence
aggtttgttgcag

SEQ ID NO: 4659 - DNA, 13 bp, Artificial Sequence
  synthetic sequence
ccagagggtgaag

SEQ ID NO: 4660 - DNA, 13 bp, Artificial Sequence
  synthetic sequence
ggatcctaggcat

SEQ ID NO: 4661 - DNA, 13 bp, Artificial Sequence
  synthetic sequence
tagatgtgaattg

SEQ ID NO: 4662 - DNA, 13 bp, Artificial Sequence
  synthetic sequence
tacctgattgggt

SEQ ID NO: 4663 - DNA, 13 bp, Artificial Sequence
  synthetic sequence
acaaaagaaacac

SEQ ID NO: 4664 - DNA, 13 bp, Artificial Sequence
  synthetic sequence
tgatcatgggatt

SEQ ID NO: 4665 - DNA, 13 bp, Artificial Sequence
  synthetic sequence
agtaaaaggtgtc

SEQ ID NO: 4666 - DNA, 13 bp, Artificial Sequence
  synthetic sequence
acattagttcaat

SEQ ID NO: 4667 - DNA, 13 bp, Artificial Sequence
  synthetic sequence
cactaggtagcaa

SEQ ID NO: 4668 - DNA, 13 bp, Artificial Sequence
  synthetic sequence
cagcaagcaatga

SEQ ID NO: 4669 - DNA, 13 bp, Artificial Sequence
  synthetic sequence
aaccaaaacaagc

SEQ ID NO: 4670 - DNA, 13 bp, Artificial Sequence
  synthetic sequence
tgaactttcaaac

SEQ ID NO: 4671 - DNA, 13 bp, Artificial Sequence
  synthetic sequence
tgtctgattctga

SEQ ID NO: 4672 - DNA, 13 bp, Artificial Sequence
  synthetic sequence
aataatggttcat

SEQ ID NO: 4673 - DNA, 13 bp, Artificial Sequence
  synthetic sequence
gtgaacagatgca

SEQ ID NO: 4674 - DNA, 13 bp, Artificial Sequence
  synthetic sequence
ttgatccattcct

SEQ ID NO: 4675 - DNA, 13 bp, Artificial Sequence
  synthetic sequence
ttgaatcagatgt

SEQ ID NO: 4676 - DNA, 13 bp, Artificial Sequence
  synthetic sequence
gttcagttttacc

SEQ ID NO: 4677 - DNA, 13 bp, Artificial Sequence
  synthetic sequence
acaaggaacaagt

SEQ ID NO: 4678 - DNA, 13 bp, Artificial Sequence
  synthetic sequence
ttggtgcattgaa

SEQ ID NO: 4679 - DNA, 13 bp, Artificial Sequence
  synthetic sequence
agtatcaaatctt

SEQ ID NO: 4680 - DNA, 13 bp, Artificial Sequence
  synthetic sequence
agatactctcatt

SEQ ID NO: 4681 - DNA, 13 bp, Artificial Sequence
  synthetic sequence
gagttgtttgggc

SEQ ID NO: 4682 - DNA, 13 bp, Artificial Sequence
  synthetic sequence
tgacagatcagat

SEQ ID NO: 4683 - DNA, 13 bp, Artificial Sequence
  synthetic sequence
ataagttaccaga

SEQ ID NO: 4684 - DNA, 13 bp, Artificial Sequence
  synthetic sequence
tgggtgcatgggt

SEQ ID NO: 4685 - DNA, 13 bp, Artificial Sequence
  synthetic sequence
aacggtggataga

SEQ ID NO: 4686 - DNA, 13 bp, Artificial Sequence
  synthetic sequence
gcagaacatgtga

SEQ ID NO: 4687 - DNA, 13 bp, Artificial Sequence
  synthetic sequence
tgagtattcttgg

SEQ ID NO: 4688 - DNA, 13 bp, Artificial Sequence
  synthetic sequence
tacctgactgggt

SEQ ID NO: 4689 - DNA, 13 bp, Artificial Sequence
  synthetic sequence
aatgctggagatc

SEQ ID NO: 4690 - DNA, 13 bp, Artificial Sequence
  synthetic sequence
atggttcactatt

SEQ ID NO: 4691 - DNA, 13 bp, Artificial Sequence
  synthetic sequence
aggacaaatctgt

SEQ ID NO: 4692 - DNA, 13 bp, Artificial Sequence
  synthetic sequence
tacttgacatggg

SEQ ID NO: 4693 - DNA, 13 bp, Artificial Sequence
  synthetic sequence
ctattgacccatt

SEQ ID NO: 4694 - DNA, 13 bp, Artificial Sequence
  synthetic sequence
catggtatgttga

SEQ ID NO: 4695 - DNA, 13 bp, Artificial Sequence
  synthetic sequence
gttggggacactt

SEQ ID NO: 4696 - DNA, 13 bp, Artificial Sequence
  synthetic sequence
ggtggaggtgttg

SEQ ID NO: 4697 - DNA, 13 bp, Artificial Sequence
  synthetic sequence
aggtacactcatt

SEQ ID NO: 4698 - DNA, 13 bp, Artificial Sequence
  synthetic sequence
aaatgtgttcggg

SEQ ID NO: 4699 - DNA, 13 bp, Artificial Sequence
  synthetic sequence
tgcagatcgaaga

SEQ ID NO: 4700 - DNA, 13 bp, Artificial Sequence
  synthetic sequence
gatgttaactgtg

SEQ ID NO: 4701 - DNA, 13 bp, Artificial Sequence
  synthetic sequence
tcctccaaaatct

SEQ ID NO: 4702 - DNA, 13 bp, Artificial Sequence
  synthetic sequence
gtcagacagtgag

SEQ ID NO: 4703 - DNA, 13 bp, Artificial Sequence
  synthetic sequence
agaaatgggttga

SEQ ID NO: 4704 - DNA, 13 bp, Artificial Sequence
  synthetic sequence
cagcaggcaatga

SEQ ID NO: 4705 - DNA, 13 bp, Artificial Sequence
  synthetic sequence
aaagaacaagtgg

SEQ ID NO: 4706 - DNA, 13 bp, Artificial Sequence
  synthetic sequence
acaatcagttatc

SEQ ID NO: 4707 - DNA, 13 bp, Artificial Sequence
  synthetic sequence
agggactgtaggg

SEQ ID NO: 4708 - DNA, 13 bp, Artificial Sequence
  synthetic sequence
ccatttttattct

SEQ ID NO: 4709 - DNA, 13 bp, Artificial Sequence
  synthetic sequence
agtccaaagagtg

SEQ ID NO: 4710 - DNA, 13 bp, Artificial Sequence
  synthetic sequence
cttttgtggggca

SEQ ID NO: 4711 - DNA, 13 bp, Artificial Sequence
  synthetic sequence
cagagggtgaggg

SEQ ID NO: 4712 - DNA, 13 bp, Artificial Sequence
  synthetic sequence
gatggaggagttg

SEQ ID NO: 4713 - DNA, 13 bp, Artificial Sequence
  synthetic sequence
tacaaagaacaag

SEQ ID NO: 4714 - DNA, 13 bp, Artificial Sequence
  synthetic sequence
acatggggcaagg

SEQ ID NO: 4715 - DNA, 13 bp, Artificial Sequence
  synthetic sequence
acaatggctctct

SEQ ID NO: 4716 - DNA, 13 bp, Artificial Sequence
  synthetic sequence
tggtttccacata

SEQ ID NO: 4717 - DNA, 13 bp, Artificial Sequence
  synthetic sequence
atcagaaaacagg

SEQ ID NO: 4718 - DNA, 13 bp, Artificial Sequence
  synthetic sequence
atcccattgatcc

SEQ ID NO: 4719 - DNA, 13 bp, Artificial Sequence
  synthetic sequence
caggtgaatgctc

SEQ ID NO: 4720 - DNA, 13 bp, Artificial Sequence
  synthetic sequence
tgaccttgttgtg

SEQ ID NO: 4721 - DNA, 13 bp, Artificial Sequence
  synthetic sequence
cagactgatccag

SEQ ID NO: 4722 - DNA, 13 bp, Artificial Sequence
  synthetic sequence
agtgttgggagcg

SEQ ID NO: 4723 - DNA, 13 bp, Artificial Sequence
  synthetic sequence
gcgatgggagaca

SEQ ID NO: 4724 - DNA, 13 bp, Artificial Sequence
  synthetic sequence
ggccaatgagagg

SEQ ID NO: 4725 - DNA, 13 bp, Artificial Sequence
  synthetic sequence
ggaaattggctgg

SEQ ID NO: 4726 - DNA, 13 bp, Artificial Sequence
  synthetic sequence
gttcctgggtgtt

SEQ ID NO: 4727 - DNA, 13 bp, Artificial Sequence
  synthetic sequence
tcattccgaaatc

SEQ ID NO: 4728 - DNA, 13 bp, Artificial Sequence
  synthetic sequence
gggttgtgcagaa

SEQ ID NO: 4729 - DNA, 13 bp, Artificial Sequence
  synthetic sequence
tgaaccctagcaa

SEQ ID NO: 4730 - DNA, 13 bp, Artificial Sequence
  synthetic sequence
accttaaaaagtg

SEQ ID NO: 4731 - DNA, 13 bp, Artificial Sequence
  synthetic sequence
aagacctttctgt

SEQ ID NO: 4732 - DNA, 13 bp, Artificial Sequence
  synthetic sequence
tctgtgcctggat

SEQ ID NO: 4733 - DNA, 13 bp, Artificial Sequence
  synthetic sequence
ttcagccaacaat

SEQ ID NO: 4734 - DNA, 13 bp, Artificial Sequence
  synthetic sequence
caccctctcagaa

SEQ ID NO: 4735 - DNA, 13 bp, Artificial Sequence
  synthetic sequence
aaatatttgtgac

SEQ ID NO: 4736 - DNA, 13 bp, Artificial Sequence
  synthetic sequence
gagattgtatcag

SEQ ID NO: 4737 - DNA, 13 bp, Artificial Sequence
  synthetic sequence
aagagggaggctg

SEQ ID NO: 4738 - DNA, 13 bp, Artificial Sequence
  synthetic sequence
cccattgacccat

SEQ ID NO: 4739 - DNA, 13 bp, Artificial Sequence
  synthetic sequence
agatttgttgcag

SEQ ID NO: 4740 - DNA, 13 bp, Artificial Sequence
  synthetic sequence
attgtctctcatt

SEQ ID NO: 4741 - DNA, 13 bp, Artificial Sequence
  synthetic sequence
agtgaactgttgc

SEQ ID NO: 4742 - DNA, 13 bp, Artificial Sequence
  synthetic sequence
tgatgaatgggaa

SEQ ID NO: 4743 - DNA, 13 bp, Artificial Sequence
  synthetic sequence
ttgagcggaggca

SEQ ID NO: 4744 - DNA, 13 bp, Artificial Sequence
  synthetic sequence
ctgacccacaagc

SEQ ID NO: 4745 - DNA, 13 bp, Artificial Sequence
  synthetic sequence
ttaattgaggagg

SEQ ID NO: 4746 - DNA, 13 bp, Artificial Sequence
  synthetic sequence
tgatcatgaatgc

SEQ ID NO: 4747 - DNA, 13 bp, Artificial Sequence
  synthetic sequence
tacggtggaggtg

SEQ ID NO: 4748 - DNA, 13 bp, Artificial Sequence
  synthetic sequence
catataaagaaca

SEQ ID NO: 4749 - DNA, 13 bp, Artificial Sequence
  synthetic sequence
tctcacatcagtt

SEQ ID NO: 4750 - DNA, 13 bp, Artificial Sequence
  synthetic sequence
agaacattgggta

SEQ ID NO: 4751 - DNA, 13 bp, Artificial Sequence
  synthetic sequence
atcttactttctg

SEQ ID NO: 4752 - DNA, 13 bp, Artificial Sequence
  synthetic sequence
gcctggtttgttg

SEQ ID NO: 4753 - DNA, 13 bp, Artificial Sequence
  synthetic sequence
tcacacccactat

SEQ ID NO: 4754 - DNA, 13 bp, Artificial Sequence
  synthetic sequence
tgcaatgttggag

SEQ ID NO: 4755 - DNA, 13 bp, Artificial Sequence
  synthetic sequence
atggaggaggaca

SEQ ID NO: 4756 - DNA, 13 bp, Artificial Sequence
  synthetic sequence
agactgaagggaa

SEQ ID NO: 4757 - DNA, 13 bp, Artificial Sequence
  synthetic sequence
ttggagcatgggt

SEQ ID NO: 4758 - DNA, 13 bp, Artificial Sequence
  synthetic sequence
ttaaagaaaagga

SEQ ID NO: 4759 - DNA, 13 bp, Artificial Sequence
  synthetic sequence
cggtggatggaca

SEQ ID NO: 4760 - DNA, 13 bp, Artificial Sequence
  synthetic sequence
gagattggtgata

SEQ ID NO: 4761 - DNA, 13 bp, Artificial Sequence
  synthetic sequence
ttgatatgggaca

SEQ ID NO: 4762 - DNA, 13 bp, Artificial Sequence
  synthetic sequence
gtctgatgctgtc

SEQ ID NO: 4763 - DNA, 13 bp, Artificial Sequence
  synthetic sequence
gcactttcacttg

SEQ ID NO: 4764 - DNA, 13 bp, Artificial Sequence
  synthetic sequence
tccaaaaccttag

SEQ ID NO: 4765 - DNA, 13 bp, Artificial Sequence
  synthetic sequence
caacaggcaatga

SEQ ID NO: 4766 - DNA, 13 bp, Artificial Sequence
  synthetic sequence
tggtggaagaaaa

SEQ ID NO: 4767 - DNA, 13 bp, Artificial Sequence
  synthetic sequence
agtttgtgagccc

SEQ ID NO: 4768 - DNA, 13 bp, Artificial Sequence
  synthetic sequence
agaattctccatg

SEQ ID NO: 4769 - DNA, 13 bp, Artificial Sequence
  synthetic sequence
gttgtccctacaa

SEQ ID NO: 4770 - DNA, 13 bp, Artificial Sequence
  synthetic sequence
ataaggaacaagt

SEQ ID NO: 4771 - DNA, 13 bp, Artificial Sequence
  synthetic sequence
acaaaggaaacac

SEQ ID NO: 4772 - DNA, 13 bp, Artificial Sequence
  synthetic sequence
ttgaagaagagta

SEQ ID NO: 4773 - DNA, 13 bp, Artificial Sequence
  synthetic sequence
cctccagggtctg

SEQ ID NO: 4774 - DNA, 13 bp, Artificial Sequence
  synthetic sequence
aacaggcgatgag

SEQ ID NO: 4775 - DNA, 13 bp, Artificial Sequence
  synthetic sequence
gtttcattggttg

SEQ ID NO: 4776 - DNA, 13 bp, Artificial Sequence
  synthetic sequence
ttgtggggcacca

SEQ ID NO: 4777 - DNA, 13 bp, Artificial Sequence
  synthetic sequence
acaatgccagtgg

SEQ ID NO: 4778 - DNA, 13 bp, Artificial Sequence
  synthetic sequence
tgcagtgttggag

SEQ ID NO: 4779 - DNA, 13 bp, Artificial Sequence
  synthetic sequence
atgtcaactgtga

SEQ ID NO: 4780 - DNA, 13 bp, Artificial Sequence
  synthetic sequence
ttgaagaggagta

SEQ ID NO: 4781 - DNA, 13 bp, Artificial Sequence
  synthetic sequence
gtctcaaataagt

SEQ ID NO: 4782 - DNA, 13 bp, Artificial Sequence
  synthetic sequence
ttcacttggttcc

SEQ ID NO: 4783 - DNA, 13 bp, Artificial Sequence
  synthetic sequence
tgtgttctgggtc

SEQ ID NO: 4784 - DNA, 13 bp, Artificial Sequence
  synthetic sequence
atcaaatgctttg

SEQ ID NO: 4785 - DNA, 13 bp, Artificial Sequence
  synthetic sequence
aacaagcaatgag

SEQ ID NO: 4786 - DNA, 13 bp, Artificial Sequence
  synthetic sequence
aacgttctcaaaa

SEQ ID NO: 4787 - DNA, 13 bp, Artificial Sequence
  synthetic sequence
ctctagcagacca

SEQ ID NO: 4788 - DNA, 13 bp, Artificial Sequence
  synthetic sequence
agacagttaaggt

SEQ ID NO: 4789 - DNA, 13 bp, Artificial Sequence
  synthetic sequence
aggggctgtaggg

SEQ ID NO: 4790 - DNA, 13 bp, Artificial Sequence
  synthetic sequence
atggaggaagata

SEQ ID NO: 4791 - DNA, 13 bp, Artificial Sequence
  synthetic sequence
atagacagcagga

SEQ ID NO: 4792 - DNA, 13 bp, Artificial Sequence
  synthetic sequence
cttctgtggggca

SEQ ID NO: 4793 - DNA, 13 bp, Artificial Sequence
  synthetic sequence
tactgacacatcc

SEQ ID NO: 4794 - DNA, 13 bp, Artificial Sequence
  synthetic sequence
tgtcttacaagga

SEQ ID NO: 4795 - DNA, 13 bp, Artificial Sequence
  synthetic sequence
actgaggtcatta

SEQ ID NO: 4796 - DNA, 13 bp, Artificial Sequence
  synthetic sequence
ccttgtctcttgt

SEQ ID NO: 4797 - DNA, 13 bp, Artificial Sequence
  synthetic sequence
ccgttactctagc

SEQ ID NO: 4798 - DNA, 13 bp, Artificial Sequence
  synthetic sequence
gaagtgaagaagg

SEQ ID NO: 4799 - DNA, 13 bp, Artificial Sequence
  synthetic sequence
caatgctggaggt

SEQ ID NO: 4800 - DNA, 13 bp, Artificial Sequence
  synthetic sequence
ccccacaattagt

SEQ ID NO: 4801 - DNA, 13 bp, Artificial Sequence
  synthetic sequence
gagaagttgggga

SEQ ID NO: 4802 - DNA, 13 bp, Artificial Sequence
  synthetic sequence
agttatcagaaaa

SEQ ID NO: 4803 - DNA, 13 bp, Artificial Sequence
  synthetic sequence
gaacactgggtag

SEQ ID NO: 4804 - DNA, 13 bp, Artificial Sequence
  synthetic sequence
catgtgaggagtt

SEQ ID NO: 4805 - DNA, 13 bp, Artificial Sequence
  synthetic sequence
ttatgaatgcaaa

SEQ ID NO: 4806 - DNA, 13 bp, Artificial Sequence
  synthetic sequence
gtccatttctatt

SEQ ID NO: 4807 - DNA, 13 bp, Artificial Sequence
  synthetic sequence
acgggaccttgtc

SEQ ID NO: 4808 - DNA, 13 bp, Artificial Sequence
  synthetic sequence
gactaaagggaag

SEQ ID NO: 4809 - DNA, 13 bp, Artificial Sequence
  synthetic sequence
ttgagcccccatc

SEQ ID NO: 4810 - DNA, 13 bp, Artificial Sequence
  synthetic sequence
atctggttctagg

SEQ ID NO: 4811 - DNA, 13 bp, Artificial Sequence
  synthetic sequence
tctaattgacaca

SEQ ID NO: 4812 - DNA, 13 bp, Artificial Sequence
  synthetic sequence
tgtatggtggggg

SEQ ID NO: 4813 - DNA, 13 bp, Artificial Sequence
  synthetic sequence
attttactttctg

SEQ ID NO: 4814 - DNA, 13 bp, Artificial Sequence
  synthetic sequence
attgaggaagagt

SEQ ID NO: 4815 - DNA, 13 bp, Artificial Sequence
  synthetic sequence
gtggtaacaggga

SEQ ID NO: 4816 - DNA, 13 bp, Artificial Sequence
  synthetic sequence
ggggcattgagtg

SEQ ID NO: 4817 - DNA, 13 bp, Artificial Sequence
  synthetic sequence
caccagctgacct

SEQ ID NO: 4818 - DNA, 13 bp, Artificial Sequence
  synthetic sequence
gtccatttttgtt

SEQ ID NO: 4819 - DNA, 13 bp, Artificial Sequence
  synthetic sequence
tgtatggtggagg

SEQ ID NO: 4820 - DNA, 13 bp, Artificial Sequence
  synthetic sequence
tgattaaaggtga

SEQ ID NO: 4821 - DNA, 13 bp, Artificial Sequence
  synthetic sequence
gggtcaatgataa

SEQ ID NO: 4822 - DNA, 13 bp, Artificial Sequence
  synthetic sequence
atgaccatggggt

SEQ ID NO: 4823 - DNA, 13 bp, Artificial Sequence
  synthetic sequence
cgggacctcattc

SEQ ID NO: 4824 - DNA, 13 bp, Artificial Sequence
  synthetic sequence
tcacacctactat

SEQ ID NO: 4825 - DNA, 13 bp, Artificial Sequence
  synthetic sequence
gacacttcatctg

SEQ ID NO: 4826 - DNA, 13 bp, Artificial Sequence
  synthetic sequence
ctctcttctgagg

SEQ ID NO: 4827 - DNA, 13 bp, Artificial Sequence
  synthetic sequence
caatacttgatat

SEQ ID NO: 4828 - DNA, 13 bp, Artificial Sequence
  synthetic sequence
aaacggttgaatc

SEQ ID NO: 4829 - DNA, 13 bp, Artificial Sequence
  synthetic sequence
gagagattggtga

SEQ ID NO: 4830 - DNA, 13 bp, Artificial Sequence
  synthetic sequence
aaacgcagtcaaa

SEQ ID NO: 4831 - DNA, 13 bp, Artificial Sequence
  synthetic sequence
acaatcagttacc

SEQ ID NO: 4832 - DNA, 13 bp, Artificial Sequence
  synthetic sequence
gtggtttccacac

SEQ ID NO: 4833 - DNA, 13 bp, Artificial Sequence
  synthetic sequence
gcagaacatgcga

SEQ ID NO: 4834 - DNA, 13 bp, Artificial Sequence
  synthetic sequence
tgtgaactgtgag

SEQ ID NO: 4835 - DNA, 13 bp, Artificial Sequence
  synthetic sequence
ccagacaattagg

SEQ ID NO: 4836 - DNA, 13 bp, Artificial Sequence
  synthetic sequence
accagaagacagg

SEQ ID NO: 4837 - DNA, 13 bp, Artificial Sequence
  synthetic sequence
agtgtgttagagg

SEQ ID NO: 4838 - DNA, 13 bp, Artificial Sequence
  synthetic sequence
ttaaggctatcta

SEQ ID NO: 4839 - DNA, 13 bp, Artificial Sequence
  synthetic sequence
ggtctgcaaaact

SEQ ID NO: 4840 - DNA, 13 bp, Artificial Sequence
  synthetic sequence
gaacggaggcaac

SEQ ID NO: 4841 - DNA, 13 bp, Artificial Sequence
  synthetic sequence
tgtctgactctga

SEQ ID NO: 4842 - DNA, 13 bp, Artificial Sequence
  synthetic sequence
tattggattgcgc

SEQ ID NO: 4843 - DNA, 13 bp, Artificial Sequence
  synthetic sequence
agacaatggatgg

SEQ ID NO: 4844 - DNA, 13 bp, Artificial Sequence
  synthetic sequence
gcttgttgttcaa

SEQ ID NO: 4845 - DNA, 13 bp, Artificial Sequence
  synthetic sequence
agaacagaaaggc

SEQ ID NO: 4846 - DNA, 13 bp, Artificial Sequence
  synthetic sequence
tggtcctttgtga

SEQ ID NO: 4847 - DNA, 13 bp, Artificial Sequence
  synthetic sequence
atctttcccccat

SEQ ID NO: 4848 - DNA, 13 bp, Artificial Sequence
  synthetic sequence
agaggcatggtca

SEQ ID NO: 4849 - DNA, 13 bp, Artificial Sequence
  synthetic sequence
tgaccagtgctgt

SEQ ID NO: 4850 - DNA, 13 bp, Artificial Sequence
  synthetic sequence
aagaggaaataac

SEQ ID NO: 4851 - DNA, 13 bp, Artificial Sequence
  synthetic sequence
tgctcatttgtgc

SEQ ID NO: 4852 - DNA, 13 bp, Artificial Sequence
  synthetic sequence
ggttactgctcca

SEQ ID NO: 4853 - DNA, 13 bp, Artificial Sequence
  synthetic sequence
ctcatctcttcca

SEQ ID NO: 4854 - DNA, 13 bp, Artificial Sequence
  synthetic sequence
cctattctcagct

SEQ ID NO: 4855 - DNA, 13 bp, Artificial Sequence
  synthetic sequence
tcatctgtgcttc

SEQ ID NO: 4856 - DNA, 13 bp, Artificial Sequence
  synthetic sequence
ctgctcaacctgg

SEQ ID NO: 4857 - DNA, 13 bp, Artificial Sequence
  synthetic sequence
agggcattgtcat

SEQ ID NO: 4858 - DNA, 13 bp, Artificial Sequence
  synthetic sequence
caagcattgacag

SEQ ID NO: 4859 - DNA, 13 bp, Artificial Sequence
  synthetic sequence
gatgctcaggctc

SEQ ID NO: 4860 - DNA, 13 bp, Artificial Sequence
  synthetic sequence
gatttgaatgatg

SEQ ID NO: 4861 - DNA, 13 bp, Artificial Sequence
  synthetic sequence
ggcaaagaagaaa

SEQ ID NO: 4862 - DNA, 13 bp, Artificial Sequence
  synthetic sequence
atcttttccactt

SEQ ID NO: 4863 - DNA, 13 bp, Artificial Sequence
  synthetic sequence
caacagggctgac

SEQ ID NO: 4864 - DNA, 13 bp, Artificial Sequence
  synthetic sequence
ccattgaagtcac

SEQ ID NO: 4865 - DNA, 13 bp, Artificial Sequence
  synthetic sequence
agataaccgatgg

SEQ ID NO: 4866 - DNA, 13 bp, Artificial Sequence
  synthetic sequence
ggacagaaaggcc

SEQ ID NO: 4867 - DNA, 13 bp, Artificial Sequence
  synthetic sequence
gttatcatgttgt

SEQ ID NO: 4868 - DNA, 13 bp, Artificial Sequence
  synthetic sequence
gtggatcctaggc

SEQ ID NO: 4869 - DNA, 13 bp, Artificial Sequence
  synthetic sequence
aacaaggtcaagt

SEQ ID NO: 4870 - DNA, 13 bp, Artificial Sequence
  synthetic sequence
catctcagtgatc

SEQ ID NO: 4871 - DNA, 13 bp, Artificial Sequence
  synthetic sequence
tggttctttgtga

SEQ ID NO: 4872 - DNA, 13 bp, Artificial Sequence
  synthetic sequence
ctttacagtcagc

SEQ ID NO: 4873 - DNA, 13 bp, Artificial Sequence
  synthetic sequence
tacaggtggtgaa

SEQ ID NO: 4874 - DNA, 13 bp, Artificial Sequence
  synthetic sequence
gcgctttgctttt

SEQ ID NO: 4875 - DNA, 13 bp, Artificial Sequence
  synthetic sequence
atactcatttgtg

SEQ ID NO: 4876 - DNA, 13 bp, Artificial Sequence
  synthetic sequence
ggcaggttgactt

SEQ ID NO: 4877 - DNA, 13 bp, Artificial Sequence
  synthetic sequence
cccgcactgtgct

SEQ ID NO: 4878 - DNA, 13 bp, Artificial Sequence
  synthetic sequence
agtcggcagggtt

SEQ ID NO: 4879 - DNA, 13 bp, Artificial Sequence
  synthetic sequence
ctatcttttccat

SEQ ID NO: 4880 - DNA, 13 bp, Artificial Sequence
  synthetic sequence
atggcatcttgaa

SEQ ID NO: 4881 - DNA, 13 bp, Artificial Sequence
  synthetic sequence
taacccctcactg

SEQ ID NO: 4882 - DNA, 13 bp, Artificial Sequence
  synthetic sequence
cattaaagtcaca

SEQ ID NO: 4883 - DNA, 13 bp, Artificial Sequence
  synthetic sequence
aggggcattgtca

SEQ ID NO: 4884 - DNA, 13 bp, Artificial Sequence
  synthetic sequence
atcctcaaatcca

SEQ ID NO: 4885 - DNA, 13 bp, Artificial Sequence
  synthetic sequence
gatgctcaagctc

SEQ ID NO: 4886 - DNA, 13 bp, Artificial Sequence
  synthetic sequence
tgaccagtgcagt

SEQ ID NO: 4887 - DNA, 13 bp, Artificial Sequence
  synthetic sequence
aaggtcattagaa

SEQ ID NO: 4888 - DNA, 13 bp, Artificial Sequence
  synthetic sequence
tatctcttccact

SEQ ID NO: 4889 - DNA, 13 bp, Artificial Sequence
  synthetic sequence
tgtactgcacact

SEQ ID NO: 4890 - DNA, 13 bp, Artificial Sequence
  synthetic sequence
caaacaatggatg

SEQ ID NO: 4891 - DNA, 13 bp, Artificial Sequence
  synthetic sequence
agtgctgtcatag

SEQ ID NO: 4892 - DNA, 13 bp, Artificial Sequence
  synthetic sequence
actttcaaccagt

SEQ ID NO: 4893 - DNA, 13 bp, Artificial Sequence
  synthetic sequence
atctcttccatct

SEQ ID NO: 4894 - DNA, 13 bp, Artificial Sequence
  synthetic sequence
ctccttatagctt

SEQ ID NO: 4895 - DNA, 13 bp, Artificial Sequence
  synthetic sequence
atctcttccattt

SEQ ID NO: 4896 - DNA, 13 bp, Artificial Sequence
  synthetic sequence
cattgaaatcaca

SEQ ID NO: 4897 - DNA, 13 bp, Artificial Sequence
  synthetic sequence
tgagtgcctcaaa

SEQ ID NO: 4898 - DNA, 13 bp, Artificial Sequence
  synthetic sequence
gaggcatagtcat

SEQ ID NO: 4899 - DNA, 13 bp, Artificial Sequence
  synthetic sequence
tgaaatcaaaagt

SEQ ID NO: 4900 - DNA, 13 bp, Artificial Sequence
  synthetic sequence
ctagttctctgtg

SEQ ID NO: 4901 - DNA, 13 bp, Artificial Sequence
  synthetic sequence
ggcaggttgacct

SEQ ID NO: 4902 - DNA, 13 bp, Artificial Sequence
  synthetic sequence
actgctccaacat

SEQ ID NO: 4903 - DNA, 13 bp, Artificial Sequence
  synthetic sequence
agaacagagaggc

SEQ ID NO: 4904 - DNA, 13 bp, Artificial Sequence
  synthetic sequence
tggttctctgtga

SEQ ID NO: 4905 - DNA, 13 bp, Artificial Sequence
  synthetic sequence
tgacctattctca

SEQ ID NO: 4906 - DNA, 13 bp, Artificial Sequence
  synthetic sequence
gctgcacagccag

SEQ ID NO: 4907 - DNA, 13 bp, Artificial Sequence
  synthetic sequence
tctctgtgatcat

SEQ ID NO: 4908 - DNA, 13 bp, Artificial Sequence
  synthetic sequence
gtaaagaagaaat

SEQ ID NO: 4909 - DNA, 13 bp, Artificial Sequence
  synthetic sequence
caaaagtcatcag

SEQ ID NO: 4910 - DNA, 13 bp, Artificial Sequence
  synthetic sequence
ggcatggtcatgt

SEQ ID NO: 4911 - DNA, 13 bp, Artificial Sequence
  synthetic sequence
tgcaatctgcagg

SEQ ID NO: 4912 - DNA, 13 bp, Artificial Sequence
  synthetic sequence
agataaccaatag

SEQ ID NO: 4913 - DNA, 13 bp, Artificial Sequence
  synthetic sequence
attctgaaggtca

SEQ ID NO: 4914 - DNA, 13 bp, Artificial Sequence
  synthetic sequence
caaaaacaagaga

SEQ ID NO: 4915 - DNA, 13 bp, Artificial Sequence
  synthetic sequence
cattaagaaaaag

SEQ ID NO: 4916 - DNA, 13 bp, Artificial Sequence
  synthetic sequence
actagattctcag

SEQ ID NO: 4917 - DNA, 13 bp, Artificial Sequence
  synthetic sequence
tcatctttctgcc

SEQ ID NO: 4918 - DNA, 13 bp, Artificial Sequence
  synthetic sequence
aagctttatgatc

SEQ ID NO: 4919 - DNA, 13 bp, Artificial Sequence
  synthetic sequence
atgcatgtcagtg

SEQ ID NO: 4920 - DNA, 13 bp, Artificial Sequence
  synthetic sequence
tttggaatagcag

SEQ ID NO: 4921 - DNA, 13 bp, Artificial Sequence
  synthetic sequence
taaatattggaca

SEQ ID NO: 4922 - DNA, 13 bp, Artificial Sequence
  synthetic sequence
tgattaagaaaaa

SEQ ID NO: 4923 - DNA, 13 bp, Artificial Sequence
  synthetic sequence
ctgcagaaattga

SEQ ID NO: 4924 - DNA, 13 bp, Artificial Sequence
  synthetic sequence
cgaagaacattaa

SEQ ID NO: 4925 - DNA, 13 bp, Artificial Sequence
  synthetic sequence
actttattaaaac

SEQ ID NO: 4926 - DNA, 13 bp, Artificial Sequence
  synthetic sequence
gaaaaagtcccag

SEQ ID NO: 4927 - DNA, 13 bp, Artificial Sequence
  synthetic sequence
aagaaaccatata

SEQ ID NO: 4928 - DNA, 13 bp, Artificial Sequence
  synthetic sequence
acctgattgttgc

SEQ ID NO: 4929 - DNA, 13 bp, Artificial Sequence
  synthetic sequence
aaaaccacacatg

SEQ ID NO: 4930 - DNA, 13 bp, Artificial Sequence
  synthetic sequence
acattggctggtg

SEQ ID NO: 4931 - DNA, 13 bp, Artificial Sequence
  synthetic sequence
agcataaatcttg

SEQ ID NO: 4932 - DNA, 13 bp, Artificial Sequence
  synthetic sequence
cagtctttttctc

SEQ ID NO: 4933 - DNA, 13 bp, Artificial Sequence
  synthetic sequence
acttgattcagag

SEQ ID NO: 4934 - DNA, 13 bp, Artificial Sequence
  synthetic sequence
ttgctttgaagga

SEQ ID NO: 4935 - DNA, 13 bp, Artificial Sequence
  synthetic sequence
tcctcttctcaat

SEQ ID NO: 4936 - DNA, 13 bp, Artificial Sequence
  synthetic sequence
gatgggttaataa

SEQ ID NO: 4937 - DNA, 13 bp, Artificial Sequence
  synthetic sequence
cttcctaatatgc

SEQ ID NO: 4938 - DNA, 13 bp, Artificial Sequence
  synthetic sequence
atacaggtattca

SEQ ID NO: 4939 - DNA, 13 bp, Artificial Sequence
  synthetic sequence
tcagatttaacat

SEQ ID NO: 4940 - DNA, 13 bp, Artificial Sequence
  synthetic sequence
gacaacagatcat

SEQ ID NO: 4941 - DNA, 13 bp, Artificial Sequence
  synthetic sequence
ctctttctaaagg

SEQ ID NO: 4942 - DNA, 13 bp, Artificial Sequence
  synthetic sequence
atagatcaagtgt

SEQ ID NO: 4943 - DNA, 13 bp, Artificial Sequence
  synthetic sequence
cattccctagtaa

SEQ ID NO: 4944 - DNA, 13 bp, Artificial Sequence
  synthetic sequence
actattaatttag

SEQ ID NO: 4945 - DNA, 13 bp, Artificial Sequence
  synthetic sequence
taatattgaacaa

SEQ ID NO: 4946 - DNA, 13 bp, Artificial Sequence
  synthetic sequence
tccagtgataaga

SEQ ID NO: 4947 - DNA, 13 bp, Artificial Sequence
  synthetic sequence
gctttactttcct

SEQ ID NO: 4948 - DNA, 13 bp, Artificial Sequence
  synthetic sequence
tttgagagaggaa

SEQ ID NO: 4949 - DNA, 13 bp, Artificial Sequence
  synthetic sequence
gctactgagccct

SEQ ID NO: 4950 - DNA, 13 bp, Artificial Sequence
  synthetic sequence
gtagtttaaattt

SEQ ID NO: 4951 - DNA, 13 bp, Artificial Sequence
  synthetic sequence
cttgaactcagtg

SEQ ID NO: 4952 - DNA, 13 bp, Artificial Sequence
  synthetic sequence
agaatactccttt

SEQ ID NO: 4953 - DNA, 13 bp, Artificial Sequence
  synthetic sequence
gtttgaatgtcag

SEQ ID NO: 4954 - DNA, 13 bp, Artificial Sequence
  synthetic sequence
atcctaaatgcaa

SEQ ID NO: 4955 - DNA, 13 bp, Artificial Sequence
  synthetic sequence
cttgaagacatag

SEQ ID NO: 4956 - DNA, 13 bp, Artificial Sequence
  synthetic sequence
aatgggaaggaca

SEQ ID NO: 4957 - DNA, 13 bp, Artificial Sequence
  synthetic sequence
ctgattatcctcc

SEQ ID NO: 4958 - DNA, 13 bp, Artificial Sequence
  synthetic sequence
attgacatatctg

SEQ ID NO: 4959 - DNA, 13 bp, Artificial Sequence
  synthetic sequence
cacataataatgt

SEQ ID NO: 4960 - DNA, 13 bp, Artificial Sequence
  synthetic sequence
ttgatcttccacc

SEQ ID NO: 4961 - DNA, 13 bp, Artificial Sequence
  synthetic sequence
atgatttatctga

SEQ ID NO: 4962 - DNA, 13 bp, Artificial Sequence
  synthetic sequence
agctagtcaagta

SEQ ID NO: 4963 - DNA, 13 bp, Artificial Sequence
  synthetic sequence
cctgatgcaaggt

SEQ ID NO: 4964 - DNA, 13 bp, Artificial Sequence
  synthetic sequence
tggtgatccccag

SEQ ID NO: 4965 - DNA, 13 bp, Artificial Sequence
  synthetic sequence
ctttcctttatcc

SEQ ID NO: 4966 - DNA, 13 bp, Artificial Sequence
  synthetic sequence
attatcaagagaa

SEQ ID NO: 4967 - DNA, 13 bp, Artificial Sequence
  synthetic sequence
caatgacacagag

SEQ ID NO: 4968 - DNA, 13 bp, Artificial Sequence
  synthetic sequence
cctgttagatttc

SEQ ID NO: 4969 - DNA, 13 bp, Artificial Sequence
  synthetic sequence
gtgtgagtggctt

SEQ ID NO: 4970 - DNA, 13 bp, Artificial Sequence
  synthetic sequence
gtgtcatgatccc

SEQ ID NO: 4971 - DNA, 13 bp, Artificial Sequence
  synthetic sequence
gtgttgaacatta

SEQ ID NO: 4972 - DNA, 13 bp, Artificial Sequence
  synthetic sequence
caaccccaaaatg

SEQ ID NO: 4973 - DNA, 13 bp, Artificial Sequence
  synthetic sequence
tatgtgggcaaaa

SEQ ID NO: 4974 - DNA, 13 bp, Artificial Sequence
  synthetic sequence
ggtctatttcaac

SEQ ID NO: 4975 - DNA, 13 bp, Artificial Sequence
  synthetic sequence
aatctatttaaaa

SEQ ID NO: 4976 - DNA, 13 bp, Artificial Sequence
  synthetic sequence
gggtgaatccttg

SEQ ID NO: 4977 - DNA, 13 bp, Artificial Sequence
  synthetic sequence
atttgtcagattc

SEQ ID NO: 4978 - DNA, 13 bp, Artificial Sequence
  synthetic sequence
aattcttacctct

SEQ ID NO: 4979 - DNA, 13 bp, Artificial Sequence
  synthetic sequence
acatttatcctta

SEQ ID NO: 4980 - DNA, 13 bp, Artificial Sequence
  synthetic sequence
acaaaacatgacc

SEQ ID NO: 4981 - DNA, 13 bp, Artificial Sequence
  synthetic sequence
ttcaactcttatt

SEQ ID NO: 4982 - DNA, 13 bp, Artificial Sequence
  synthetic sequence
aaacaccaccaat

SEQ ID NO: 4983 - DNA, 13 bp, Artificial Sequence
  synthetic sequence
ccctctactctga

SEQ ID NO: 4984 - DNA, 13 bp, Artificial Sequence
  synthetic sequence
ttttagatacaag

SEQ ID NO: 4985 - DNA, 13 bp, Artificial Sequence
  synthetic sequence
tcaactcaactga

SEQ ID NO: 4986 - DNA, 13 bp, Artificial Sequence
  synthetic sequence
tctgatgcggtca

SEQ ID NO: 4987 - DNA, 13 bp, Artificial Sequence
  synthetic sequence
tgaatattcaaac

SEQ ID NO: 4988 - DNA, 13 bp, Artificial Sequence
  synthetic sequence
tctggagaacagg

SEQ ID NO: 4989 - DNA, 13 bp, Artificial Sequence
  synthetic sequence
caaatttatttaa

SEQ ID NO: 4990 - DNA, 13 bp, Artificial Sequence
  synthetic sequence
cctctagatattc

SEQ ID NO: 4991 - DNA, 13 bp, Artificial Sequence
  synthetic sequence
aatttctcttatc

SEQ ID NO: 4992 - DNA, 13 bp, Artificial Sequence
  synthetic sequence
caacccttatcgc

SEQ ID NO: 4993 - DNA, 13 bp, Artificial Sequence
  synthetic sequence
ggtttgctgacgt

SEQ ID NO: 4994 - DNA, 13 bp, Artificial Sequence
  synthetic sequence
tttagtatcctat

SEQ ID NO: 4995 - DNA, 13 bp, Artificial Sequence
  synthetic sequence
tatttgtcaaatt

SEQ ID NO: 4996 - DNA, 13 bp, Artificial Sequence
  synthetic sequence
tgtgaatggcttt

SEQ ID NO: 4997 - DNA, 13 bp, Artificial Sequence
  synthetic sequence
agcaataattgat

SEQ ID NO: 4998 - DNA, 13 bp, Artificial Sequence
  synthetic sequence
agctggataccat

SEQ ID NO: 4999 - DNA, 13 bp, Artificial Sequence
  synthetic sequence
tttccttggagca

SEQ ID NO: 5000 - DNA, 13 bp, Artificial Sequence
  synthetic sequence
tttcacatttgat

SEQ ID NO: 5001 - DNA, 13 bp, Artificial Sequence
  synthetic sequence
tcagaactcataa

SEQ ID NO: 5002 - DNA, 13 bp, Artificial Sequence
  synthetic sequence
atcaccccagttg

SEQ ID NO: 5003 - DNA, 13 bp, Artificial Sequence
  synthetic sequence
attaccctaaatg

SEQ ID NO: 5004 - DNA, 13 bp, Artificial Sequence
  synthetic sequence
tcccaatgattat

SEQ ID NO: 5005 - DNA, 13 bp, Artificial Sequence
  synthetic sequence
cataattttagat

SEQ ID NO: 5006 - DNA, 13 bp, Artificial Sequence
  synthetic sequence
aaagggggccgat

SEQ ID NO: 5007 - DNA, 13 bp, Artificial Sequence
  synthetic sequence
gttttagaaattg

SEQ ID NO: 5008 - DNA, 13 bp, Artificial Sequence
  synthetic sequence
gattcccaggaac

SEQ ID NO: 5009 - DNA, 13 bp, Artificial Sequence
  synthetic sequence
atacaatccccct

SEQ ID NO: 5010 - DNA, 13 bp, Artificial Sequence
  synthetic sequence
aactcacagaaat

SEQ ID NO: 5011 - DNA, 13 bp, Artificial Sequence
  synthetic sequence
tatttcaactcag

SEQ ID NO: 5012 - DNA, 13 bp, Artificial Sequence
  synthetic sequence
tcatattataagg

SEQ ID NO: 5013 - DNA, 13 bp, Artificial Sequence
  synthetic sequence
tgtcatggcccca

SEQ ID NO: 5014 - DNA, 13 bp, Artificial Sequence
  synthetic sequence
tctaactattcaa

SEQ ID NO: 5015 - DNA, 13 bp, Artificial Sequence
  synthetic sequence
accaataatgata

SEQ ID NO: 5016 - DNA, 13 bp, Artificial Sequence
  synthetic sequence
attcaaagataat

SEQ ID NO: 5017 - DNA, 13 bp, Artificial Sequence
  synthetic sequence
tctttaaaaatta

SEQ ID NO: 5018 - DNA, 13 bp, Artificial Sequence
  synthetic sequence
cctttatcctaat

SEQ ID NO: 5019 - DNA, 13 bp, Artificial Sequence
  synthetic sequence
aaacattaaatgg

SEQ ID NO: 5020 - DNA, 13 bp, Artificial Sequence
  synthetic sequence
agatatttattct

SEQ ID NO: 5021 - DNA, 13 bp, Artificial Sequence
  synthetic sequence
aaggatattgaga

SEQ ID NO: 5022 - DNA, 13 bp, Artificial Sequence
  synthetic sequence
gtttggctttatt

SEQ ID NO: 5023 - DNA, 13 bp, Artificial Sequence
  synthetic sequence
ccttctgagtgtc

SEQ ID NO: 5024 - DNA, 13 bp, Artificial Sequence
  synthetic sequence
gacaaaatgtcaa

SEQ ID NO: 5025 - DNA, 13 bp, Artificial Sequence
  synthetic sequence
ttgagtctaaatg

SEQ ID NO: 5026 - DNA, 13 bp, Artificial Sequence
  synthetic sequence
ggtcgaagataat

SEQ ID NO: 5027 - DNA, 13 bp, Artificial Sequence
  synthetic sequence
gtaaatttaatca

SEQ ID NO: 5028 - DNA, 13 bp, Artificial Sequence
  synthetic sequence
agacacggcatat

SEQ ID NO: 5029 - DNA, 13 bp, Artificial Sequence
  synthetic sequence
atgatgatttgtc

SEQ ID NO: 5030 - DNA, 13 bp, Artificial Sequence
  synthetic sequence
ctccattatatgc

SEQ ID NO: 5031 - DNA, 13 bp, Artificial Sequence
  synthetic sequence
ttgtaagacttgt

SEQ ID NO: 5032 - DNA, 13 bp, Artificial Sequence
  synthetic sequence
agccctttgtcta

SEQ ID NO: 5033 - DNA, 13 bp, Artificial Sequence
  synthetic sequence
aaaatattaagac

SEQ ID NO: 5034 - DNA, 13 bp, Artificial Sequence
  synthetic sequence
tgagccaccctca

SEQ ID NO: 5035 - DNA, 13 bp, Artificial Sequence
  synthetic sequence
tcatgtcacttct

SEQ ID NO: 5036 - DNA, 13 bp, Artificial Sequence
  synthetic sequence
aaaatactatcaa

SEQ ID NO: 5037 - DNA, 13 bp, Artificial Sequence
  synthetic sequence
taatatggggttt

SEQ ID NO: 5038 - DNA, 13 bp, Artificial Sequence
  synthetic sequence
tgatggttgttac

SEQ ID NO: 5039 - DNA, 13 bp, Artificial Sequence
  synthetic sequence
acacacagagcac

SEQ ID NO: 5040 - DNA, 13 bp, Artificial Sequence
  synthetic sequence
atcaattaagaac

SEQ ID NO: 5041 - DNA, 13 bp, Artificial Sequence
  synthetic sequence
tcaggtgtttggt

SEQ ID NO: 5042 - DNA, 13 bp, Artificial Sequence
  synthetic sequence
atcattgtgcctt

SEQ ID NO: 5043 - DNA, 13 bp, Artificial Sequence
  synthetic sequence
tacacaggtattc

SEQ ID NO: 5044 - DNA, 13 bp, Artificial Sequence
  synthetic sequence
ttgttgagaccct

SEQ ID NO: 5045 - DNA, 13 bp, Artificial Sequence
  synthetic sequence
aaaacatgaccaa

SEQ ID NO: 5046 - DNA, 13 bp, Artificial Sequence
  synthetic sequence
agtagtgcagaaa

SEQ ID NO: 5047 - DNA, 13 bp, Artificial Sequence
  synthetic sequence
ctttccaaagggc

SEQ ID NO: 5048 - DNA, 13 bp, Artificial Sequence
  synthetic sequence
aacatagaaaaca

SEQ ID NO: 5049 - DNA, 13 bp, Artificial Sequence
  synthetic sequence
atataattactca

SEQ ID NO: 5050 - DNA, 13 bp, Artificial Sequence
  synthetic sequence
gagctttatcctt

SEQ ID NO: 5051 - DNA, 13 bp, Artificial Sequence
  synthetic sequence
ggaaggcgacatg

SEQ ID NO: 5052 - DNA, 13 bp, Artificial Sequence
  synthetic sequence
ctaagtaaactca

SEQ ID NO: 5053 - DNA, 13 bp, Artificial Sequence
  synthetic sequence
tctgcataagaag

SEQ ID NO: 5054 - DNA, 13 bp, Artificial Sequence
  synthetic sequence
aattgcttattcc

SEQ ID NO: 5055 - DNA, 13 bp, Artificial Sequence
  synthetic sequence
tcacaaaaacaat

SEQ ID NO: 5056 - DNA, 13 bp, Artificial Sequence
  synthetic sequence
agatcaagaattg

SEQ ID NO: 5057 - DNA, 13 bp, Artificial Sequence
  synthetic sequence
ctcagttggatac

SEQ ID NO: 5058 - DNA, 13 bp, Artificial Sequence
  synthetic sequence
gatagctagtaac

SEQ ID NO: 5059 - DNA, 13 bp, Artificial Sequence
  synthetic sequence
agaccatcttaat

SEQ ID NO: 5060 - DNA, 13 bp, Artificial Sequence
  synthetic sequence
ccaaaacttgtcg

SEQ ID NO: 5061 - DNA, 13 bp, Artificial Sequence
  synthetic sequence
aaatagtataaat

SEQ ID NO: 5062 - DNA, 13 bp, Artificial Sequence
  synthetic sequence
catgacttgattc

SEQ ID NO: 5063 - DNA, 13 bp, Artificial Sequence
  synthetic sequence
taccggaacataa

SEQ ID NO: 5064 - DNA, 13 bp, Artificial Sequence
  synthetic sequence
ggctctcaaaaga

SEQ ID NO: 5065 - DNA, 13 bp, Artificial Sequence
  synthetic sequence
tggggaacaggaa

SEQ ID NO: 5066 - DNA, 13 bp, Artificial Sequence
  synthetic sequence
acccgattgttgc

SEQ ID NO: 5067 - DNA, 13 bp, Artificial Sequence
  synthetic sequence
tgttttgtgttac

SEQ ID NO: 5068 - DNA, 13 bp, Artificial Sequence
  synthetic sequence
taattcttttcta

SEQ ID NO: 5069 - DNA, 13 bp, Artificial Sequence
  synthetic sequence
cttgcacgtggat

SEQ ID NO: 5070 - DNA, 13 bp, Artificial Sequence
  synthetic sequence
ttacacttatatt

SEQ ID NO: 5071 - DNA, 13 bp, Artificial Sequence
  synthetic sequence
ttgttatacattg

SEQ ID NO: 5072 - DNA, 13 bp, Artificial Sequence
  synthetic sequence
gacctgtcaccaa

SEQ ID NO: 5073 - DNA, 13 bp, Artificial Sequence
  synthetic sequence
ccttgagtcaccc

SEQ ID NO: 5074 - DNA, 13 bp, Artificial Sequence
  synthetic sequence
agctgaggataga

SEQ ID NO: 5075 - DNA, 13 bp, Artificial Sequence
  synthetic sequence
ttattattctatt

SEQ ID NO: 5076 - DNA, 13 bp, Artificial Sequence
  synthetic sequence
tcatttacaacat

SEQ ID NO: 5077 - DNA, 13 bp, Artificial Sequence
  synthetic sequence
ctgtcccaacact

SEQ ID NO: 5078 - DNA, 13 bp, Artificial Sequence
  synthetic sequence
ctctccaataatt

SEQ ID NO: 5079 - DNA, 13 bp, Artificial Sequence
  synthetic sequence
ctgcatcacaatc

SEQ ID NO: 5080 - DNA, 13 bp, Artificial Sequence
  synthetic sequence
gattatattacta

SEQ ID NO: 5081 - DNA, 13 bp, Artificial Sequence
  synthetic sequence
agtgtttggacat

SEQ ID NO: 5082 - DNA, 13 bp, Artificial Sequence
  synthetic sequence
gattaattgcatc

SEQ ID NO: 5083 - DNA, 13 bp, Artificial Sequence
  synthetic sequence
gaaatgtttagtg

SEQ ID NO: 5084 - DNA, 13 bp, Artificial Sequence
  synthetic sequence
accctctttgtcc

SEQ ID NO: 5085 - DNA, 13 bp, Artificial Sequence
  synthetic sequence
caaatggatcatt

SEQ ID NO: 5086 - DNA, 13 bp, Artificial Sequence
  synthetic sequence
gcctgagcattct

SEQ ID NO: 5087 - DNA, 13 bp, Artificial Sequence
  synthetic sequence
ccttgtccttgcc

SEQ ID NO: 5088 - DNA, 13 bp, Artificial Sequence
  synthetic sequence
tgattatcctcat

SEQ ID NO: 5089 - DNA, 13 bp, Artificial Sequence
  synthetic sequence
cttttccagtcat

SEQ ID NO: 5090 - DNA, 13 bp, Artificial Sequence
  synthetic sequence
gtattggggagca

SEQ ID NO: 5091 - DNA, 13 bp, Artificial Sequence
  synthetic sequence
tcatcataatatg

SEQ ID NO: 5092 - DNA, 13 bp, Artificial Sequence
  synthetic sequence
agggagagttttt

SEQ ID NO: 5093 - DNA, 13 bp, Artificial Sequence
  synthetic sequence
ctaataaaaacac

SEQ ID NO: 5094 - DNA, 13 bp, Artificial Sequence
  synthetic sequence
agtaagaagtcaa

SEQ ID NO: 5095 - DNA, 13 bp, Artificial Sequence
  synthetic sequence
actctgcctaatc

SEQ ID NO: 5096 - DNA, 13 bp, Artificial Sequence
  synthetic sequence
ctatcaaaacaag

SEQ ID NO: 5097 - DNA, 13 bp, Artificial Sequence
  synthetic sequence
gcttgttgggcaa

SEQ ID NO: 5098 - DNA, 13 bp, Artificial Sequence
  synthetic sequence
aggattcacttaa

SEQ ID NO: 5099 - DNA, 13 bp, Artificial Sequence
  synthetic sequence
aacagttaattat

SEQ ID NO: 5100 - DNA, 13 bp, Artificial Sequence
  synthetic sequence
attcttcacacca

SEQ ID NO: 5101 - DNA, 13 bp, Artificial Sequence
  synthetic sequence
tctgagattcagt

SEQ ID NO: 5102 - DNA, 13 bp, Artificial Sequence
  synthetic sequence
aacttgctgtaag

SEQ ID NO: 5103 - DNA, 13 bp, Artificial Sequence
  synthetic sequence
gataaccctccta

SEQ ID NO: 5104 - DNA, 13 bp, Artificial Sequence
  synthetic sequence
ataatgattcttt

SEQ ID NO: 5105 - DNA, 13 bp, Artificial Sequence
  synthetic sequence
cttagaggtacaa

SEQ ID NO: 5106 - DNA, 13 bp, Artificial Sequence
  synthetic sequence
cttaatttcatca

SEQ ID NO: 5107 - DNA, 13 bp, Artificial Sequence
  synthetic sequence
catgttcctcccc

SEQ ID NO: 5108 - DNA, 13 bp, Artificial Sequence
  synthetic sequence
tacgacaaataca

SEQ ID NO: 5109 - DNA, 13 bp, Artificial Sequence
  synthetic sequence
actttaatatatc

SEQ ID NO: 5110 - DNA, 13 bp, Artificial Sequence
  synthetic sequence
gcaagttgtaacg

SEQ ID NO: 5111 - DNA, 13 bp, Artificial Sequence
  synthetic sequence
tacctctcaatga

SEQ ID NO: 5112 - DNA, 13 bp, Artificial Sequence
  synthetic sequence
atacagcagtgtt

SEQ ID NO: 5113 - DNA, 13 bp, Artificial Sequence
  synthetic sequence
actattaagttag

SEQ ID NO: 5114 - DNA, 13 bp, Artificial Sequence
  synthetic sequence
aagatatattttg

SEQ ID NO: 5115 - DNA, 13 bp, Artificial Sequence
  synthetic sequence
aaatgaagttctc

SEQ ID NO: 5116 - DNA, 13 bp, Artificial Sequence
  synthetic sequence
tgagtgggtgtgc

SEQ ID NO: 5117 - DNA, 13 bp, Artificial Sequence
  synthetic sequence
acggttctataat

SEQ ID NO: 5118 - DNA, 13 bp, Artificial Sequence
  synthetic sequence
ttggtcttgcggg

SEQ ID NO: 5119 - DNA, 13 bp, Artificial Sequence
  synthetic sequence
gctcaatttcatg

SEQ ID NO: 5120 - DNA, 13 bp, Artificial Sequence
  synthetic sequence
gttggattcgcat

SEQ ID NO: 5121 - DNA, 13 bp, Artificial Sequence
  synthetic sequence
agatttttataat

SEQ ID NO: 5122 - DNA, 13 bp, Artificial Sequence
  synthetic sequence
tcctcatcatcac

SEQ ID NO: 5123 - DNA, 13 bp, Artificial Sequence
  synthetic sequence
ttatacaacattc

SEQ ID NO: 5124 - DNA, 13 bp, Artificial Sequence
  synthetic sequence
tcgacaattttcg

SEQ ID NO: 5125 - DNA, 13 bp, Artificial Sequence
  synthetic sequence
tgagagtcagttg

SEQ ID NO: 5126 - DNA, 13 bp, Artificial Sequence
  synthetic sequence
ctttaaattaacc

SEQ ID NO: 5127 - DNA, 13 bp, Artificial Sequence
  synthetic sequence
gcagacattccct

SEQ ID NO: 5128 - DNA, 13 bp, Artificial Sequence
  synthetic sequence
aagggtccacacc

SEQ ID NO: 5129 - DNA, 13 bp, Artificial Sequence
  synthetic sequence
agtcatacggcaa

SEQ ID NO: 5130 - DNA, 13 bp, Artificial Sequence
  synthetic sequence
catgctaatttaa

SEQ ID NO: 5131 - DNA, 13 bp, Artificial Sequence
  synthetic sequence
tcacttgtcatca

SEQ ID NO: 5132 - DNA, 13 bp, Artificial Sequence
  synthetic sequence
caaaactgagcaa

SEQ ID NO: 5133 - DNA, 13 bp, Artificial Sequence
  synthetic sequence
aagtcgttaatga

SEQ ID NO: 5134 - DNA, 13 bp, Artificial Sequence
  synthetic sequence
caataatcactgt

SEQ ID NO: 5135 - DNA, 13 bp, Artificial Sequence
  synthetic sequence
tgttgagtagtcg

SEQ ID NO: 5136 - DNA, 13 bp, Artificial Sequence
  synthetic sequence
gttgtcaataaat

SEQ ID NO: 5137 - DNA, 13 bp, Artificial Sequence
  synthetic sequence
aaatactccttcc

SEQ ID NO: 5138 - DNA, 13 bp, Artificial Sequence
  synthetic sequence
ctaaatagttacc

SEQ ID NO: 5139 - DNA, 13 bp, Artificial Sequence
  synthetic sequence
tcagagtggataa

SEQ ID NO: 5140 - DNA, 13 bp, Artificial Sequence
  synthetic sequence
atagcaattttgc

SEQ ID NO: 5141 - DNA, 13 bp, Artificial Sequence
  synthetic sequence
atacaagatgttg

SEQ ID NO: 5142 - DNA, 13 bp, Artificial Sequence
  synthetic sequence
actttgtattaag

SEQ ID NO: 5143 - DNA, 13 bp, Artificial Sequence
  synthetic sequence
gaaccttgaagat

SEQ ID NO: 5144 - DNA, 13 bp, Artificial Sequence
  synthetic sequence
tatctatgttata

SEQ ID NO: 5145 - DNA, 13 bp, Artificial Sequence
  synthetic sequence
actgatcatctag

SEQ ID NO: 5146 - DNA, 13 bp, Artificial Sequence
  synthetic sequence
atcattgtccttt

SEQ ID NO: 5147 - DNA, 13 bp, Artificial Sequence
  synthetic sequence
ataaggtcctcat

SEQ ID NO: 5148 - DNA, 13 bp, Artificial Sequence
  synthetic sequence
attctgtcatagt

SEQ ID NO: 5149 - DNA, 13 bp, Artificial Sequence
  synthetic sequence
agatcctcaaagc

SEQ ID NO: 5150 - DNA, 13 bp, Artificial Sequence
  synthetic sequence
actgaaattattg

SEQ ID NO: 5151 - DNA, 13 bp, Artificial Sequence
  synthetic sequence
aagttgtaacgtg

SEQ ID NO: 5152 - DNA, 13 bp, Artificial Sequence
  synthetic sequence
cctgagaatcagt

SEQ ID NO: 5153 - DNA, 13 bp, Artificial Sequence
  synthetic sequence
ataccaaaaagag

SEQ ID NO: 5154 - DNA, 13 bp, Artificial Sequence
  synthetic sequence
ccttgcatgttcc

SEQ ID NO: 5155 - DNA, 13 bp, Artificial Sequence
  synthetic sequence
ctttaatcatgat

SEQ ID NO: 5156 - DNA, 13 bp, Artificial Sequence
  synthetic sequence
tcattgtaatact

SEQ ID NO: 5157 - DNA, 13 bp, Artificial Sequence
  synthetic sequence
ttagtgaagatac

SEQ ID NO: 5158 - DNA, 13 bp, Artificial Sequence
  synthetic sequence
cctattgtatttt

SEQ ID NO: 5159 - DNA, 13 bp, Artificial Sequence
  synthetic sequence
cttggtttccttc

SEQ ID NO: 5160 - DNA, 13 bp, Artificial Sequence
  synthetic sequence
atactgctcataa

SEQ ID NO: 5161 - DNA, 13 bp, Artificial Sequence
  synthetic sequence
taacaataattat

SEQ ID NO: 5162 - DNA, 13 bp, Artificial Sequence
  synthetic sequence
ctccccctttgag

SEQ ID NO: 5163 - DNA, 13 bp, Artificial Sequence
  synthetic sequence
aacttttggctgg

SEQ ID NO: 5164 - DNA, 13 bp, Artificial Sequence
  synthetic sequence
cgtactgcaataa

SEQ ID NO: 5165 - DNA, 13 bp, Artificial Sequence
  synthetic sequence
agtactgaggttg

SEQ ID NO: 5166 - DNA, 13 bp, Artificial Sequence
  synthetic sequence
tttttaacaccgt

SEQ ID NO: 5167 - DNA, 13 bp, Artificial Sequence
  synthetic sequence
tattagattagct

SEQ ID NO: 5168 - DNA, 13 bp, Artificial Sequence
  synthetic sequence
acccaattatctt

SEQ ID NO: 5169 - DNA, 13 bp, Artificial Sequence
  synthetic sequence
gtaaataaatgag

SEQ ID NO: 5170 - DNA, 13 bp, Artificial Sequence
  synthetic sequence
ttctccgggttta

SEQ ID NO: 5171 - DNA, 13 bp, Artificial Sequence
  synthetic sequence
tattgaagaatat

SEQ ID NO: 5172 - DNA, 13 bp, Artificial Sequence
  synthetic sequence
tcatatctattac

SEQ ID NO: 5173 - DNA, 13 bp, Artificial Sequence
  synthetic sequence
accatttatcacg

SEQ ID NO: 5174 - DNA, 13 bp, Artificial Sequence
  synthetic sequence
ataaacttaaaga

SEQ ID NO: 5175 - DNA, 13 bp, Artificial Sequence
  synthetic sequence
aagtcaatcatta

SEQ ID NO: 5176 - DNA, 13 bp, Artificial Sequence
  synthetic sequence
ctacttgaattta

SEQ ID NO: 5177 - DNA, 13 bp, Artificial Sequence
  synthetic sequence
ctcttaatctcat

SEQ ID NO: 5178 - DNA, 13 bp, Artificial Sequence
  synthetic sequence
gaatacttaagca

SEQ ID NO: 5179 - DNA, 13 bp, Artificial Sequence
  synthetic sequence
aagataaggattt

SEQ ID NO: 5180 - DNA, 13 bp, Artificial Sequence
  synthetic sequence
catttcgcttagg

SEQ ID NO: 5181 - DNA, 13 bp, Artificial Sequence
  synthetic sequence
atagaaacacagg

SEQ ID NO: 5182 - DNA, 13 bp, Artificial Sequence
  synthetic sequence
aatcttcccttta

SEQ ID NO: 5183 - DNA, 13 bp, Artificial Sequence
  synthetic sequence
gcacaattaaaaa

SEQ ID NO: 5184 - DNA, 13 bp, Artificial Sequence
  synthetic sequence
catttttaaccat

SEQ ID NO: 5185 - DNA, 13 bp, Artificial Sequence
  synthetic sequence
ttgcatccaaaag

SEQ ID NO: 5186 - DNA, 13 bp, Artificial Sequence
  synthetic sequence
ttttatcacttat

SEQ ID NO: 5187 - DNA, 13 bp, Artificial Sequence
  synthetic sequence
taagattggaata

SEQ ID NO: 5188 - DNA, 13 bp, Artificial Sequence
  synthetic sequence
tcatatggcaaaa

SEQ ID NO: 5189 - DNA, 13 bp, Artificial Sequence
  synthetic sequence
attcttaaaaagt

SEQ ID NO: 5190 - DNA, 13 bp, Artificial Sequence
  synthetic sequence
tatcgaagtggat

SEQ ID NO: 5191 - DNA, 13 bp, Artificial Sequence
  synthetic sequence
agaattgattgct

SEQ ID NO: 5192 - DNA, 13 bp, Artificial Sequence
  synthetic sequence
ggtgttgttagta

SEQ ID NO: 5193 - DNA, 13 bp, Artificial Sequence
  synthetic sequence
tccttccagtaaa

SEQ ID NO: 5194 - DNA, 13 bp, Artificial Sequence
  synthetic sequence
gaattgtttataa

SEQ ID NO: 5195 - DNA, 13 bp, Artificial Sequence
  synthetic sequence
atcaataatgttt

SEQ ID NO: 5196 - DNA, 13 bp, Artificial Sequence
  synthetic sequence
ttatgagcaataa

SEQ ID NO: 5197 - DNA, 13 bp, Artificial Sequence
  synthetic sequence
ccttcatagtcta

SEQ ID NO: 5198 - DNA, 13 bp, Artificial Sequence
  synthetic sequence
taaccgtgctgtg

SEQ ID NO: 5199 - DNA, 13 bp, Artificial Sequence
  synthetic sequence
tctcctgagagtc

SEQ ID NO: 5200 - DNA, 13 bp, Artificial Sequence
  synthetic sequence
cataatatgattt

SEQ ID NO: 5201 - DNA, 13 bp, Artificial Sequence
  synthetic sequence
gaattaagacaag

SEQ ID NO: 5202 - DNA, 13 bp, Artificial Sequence
  synthetic sequence
ctttgatggtcga

SEQ ID NO: 5203 - DNA, 13 bp, Artificial Sequence
  synthetic sequence
taagaccgataaa

SEQ ID NO: 5204 - DNA, 13 bp, Artificial Sequence
  synthetic sequence
tgaaaccatccac

SEQ ID NO: 5205 - DNA, 13 bp, Artificial Sequence
  synthetic sequence
atttttgtgctga

SEQ ID NO: 5206 - DNA, 13 bp, Artificial Sequence
  synthetic sequence
ataacgtagtttt

SEQ ID NO: 5207 - DNA, 13 bp, Artificial Sequence
  synthetic sequence
ctatctcatttga

SEQ ID NO: 5208 - DNA, 13 bp, Artificial Sequence
  synthetic sequence
atccttcaagatt

SEQ ID NO: 5209 - DNA, 13 bp, Artificial Sequence
  synthetic sequence
ttgaattaagata

SEQ ID NO: 5210 - DNA, 13 bp, Artificial Sequence
  synthetic sequence
ttgttgcatgtat

SEQ ID NO: 5211 - DNA, 13 bp, Artificial Sequence
  synthetic sequence
tattagggagcat

SEQ ID NO: 5212 - DNA, 13 bp, Artificial Sequence
  synthetic sequence
tgaggtcctcatc

SEQ ID NO: 5213 - DNA, 13 bp, Artificial Sequence
  synthetic sequence
atcaaagatagag

SEQ ID NO: 5214 - DNA, 13 bp, Artificial Sequence
  synthetic sequence
cgcgcatattgag

SEQ ID NO: 5215 - DNA, 13 bp, Artificial Sequence
  synthetic sequence
acaagtcggcatg

SEQ ID NO: 5216 - DNA, 13 bp, Artificial Sequence
  synthetic sequence
ggccacactttta

SEQ ID NO: 5217 - DNA, 13 bp, Artificial Sequence
  synthetic sequence
gcaaatgagacaa

SEQ ID NO: 5218 - DNA, 13 bp, Artificial Sequence
  synthetic sequence
ttgctgcaggggg

SEQ ID NO: 5219 - DNA, 13 bp, Artificial Sequence
  synthetic sequence
tcctctacaggga

SEQ ID NO: 5220 - DNA, 13 bp, Artificial Sequence
  synthetic sequence
aaaaacttaggaa

SEQ ID NO: 5221 - DNA, 13 bp, Artificial Sequence
  synthetic sequence
tgtggatattggc

SEQ ID NO: 5222 - DNA, 13 bp, Artificial Sequence
  synthetic sequence
cttcacaatcaat

SEQ ID NO: 5223 - DNA, 13 bp, Artificial Sequence
  synthetic sequence
cagataattgaat

SEQ ID NO: 5224 - DNA, 13 bp, Artificial Sequence
  synthetic sequence
gaagggtattgtc

SEQ ID NO: 5225 - DNA, 13 bp, Artificial Sequence
  synthetic sequence
ccattaaaaaggg

SEQ ID NO: 5226 - DNA, 13 bp, Artificial Sequence
  synthetic sequence
tgcccaatataac

SEQ ID NO: 5227 - DNA, 13 bp, Artificial Sequence
  synthetic sequence
aacttagggtgca

SEQ ID NO: 5228 - DNA, 13 bp, Artificial Sequence
  synthetic sequence
atgcttcacatgg

SEQ ID NO: 5229 - DNA, 13 bp, Artificial Sequence
  synthetic sequence
aaggcagaggcta

SEQ ID NO: 5230 - DNA, 13 bp, Artificial Sequence
  synthetic sequence
acacaactgtgtg

SEQ ID NO: 5231 - DNA, 13 bp, Artificial Sequence
  synthetic sequence
cagagtcctactt

SEQ ID NO: 5232 - DNA, 13 bp, Artificial Sequence
  synthetic sequence
tatacagaaatcc

SEQ ID NO: 5233 - DNA, 13 bp, Artificial Sequence
  synthetic sequence
ccagtcttcacat

SEQ ID NO: 5234 - DNA, 13 bp, Artificial Sequence
  synthetic sequence
gaggaattggcag

SEQ ID NO: 5235 - DNA, 13 bp, Artificial Sequence
  synthetic sequence
accacaatctcca

SEQ ID NO: 5236 - DNA, 13 bp, Artificial Sequence
  synthetic sequence
tgaaacccatcat

SEQ ID NO: 5237 - DNA, 13 bp, Artificial Sequence
  synthetic sequence
tttacggccttga

SEQ ID NO: 5238 - DNA, 13 bp, Artificial Sequence
  synthetic sequence
gttcctgcgttac

SEQ ID NO: 5239 - DNA, 13 bp, Artificial Sequence
  synthetic sequence
ccactgagcttga

SEQ ID NO: 5240 - DNA, 13 bp, Artificial Sequence
  synthetic sequence
tccataaaagcct

SEQ ID NO: 5241 - DNA, 13 bp, Artificial Sequence
  synthetic sequence
tgtacccgatgag

SEQ ID NO: 5242 - DNA, 13 bp, Artificial Sequence
  synthetic sequence
tgggatggccaag

SEQ ID NO: 5243 - DNA, 13 bp, Artificial Sequence
  synthetic sequence
atgtggctgctga

SEQ ID NO: 5244 - DNA, 13 bp, Artificial Sequence
  synthetic sequence
ccatccaagtcgg

SEQ ID NO: 5245 - DNA, 13 bp, Artificial Sequence
  synthetic sequence
agcaattggatca

SEQ ID NO: 5246 - DNA, 13 bp, Artificial Sequence
  synthetic sequence
ccaacccattgat

SEQ ID NO: 5247 - DNA, 13 bp, Artificial Sequence
  synthetic sequence
gttgggaatgtca

SEQ ID NO: 5248 - DNA, 13 bp, Artificial Sequence
  synthetic sequence
gtgatcaatccag

SEQ ID NO: 5249 - DNA, 13 bp, Artificial Sequence
  synthetic sequence
ttggatgtggtga

SEQ ID NO: 5250 - DNA, 13 bp, Artificial Sequence
  synthetic sequence
ccaattctagatc

SEQ ID NO: 5251 - DNA, 13 bp, Artificial Sequence
  synthetic sequence
aatgctggaattc

SEQ ID NO: 5252 - DNA, 13 bp, Artificial Sequence
  synthetic sequence
aactcggtatcac

SEQ ID NO: 5253 - DNA, 13 bp, Artificial Sequence
  synthetic sequence
tgatgatgagctg

SEQ ID NO: 5254 - DNA, 13 bp, Artificial Sequence
  synthetic sequence
atgtcatagaggg

SEQ ID NO: 5255 - DNA, 13 bp, Artificial Sequence
  synthetic sequence
tcaaggttagtcc

SEQ ID NO: 5256 - DNA, 13 bp, Artificial Sequence
  synthetic sequence
gactcttcattcc

SEQ ID NO: 5257 - DNA, 13 bp, Artificial Sequence
  synthetic sequence
ctcaaagatatca

SEQ ID NO: 5258 - DNA, 13 bp, Artificial Sequence
  synthetic sequence
ttcactatctact

SEQ ID NO: 5259 - DNA, 13 bp, Artificial Sequence
  synthetic sequence
ctgaccctccccc

SEQ ID NO: 5260 - DNA, 13 bp, Artificial Sequence
  synthetic sequence
ggtttgagccctt

SEQ ID NO: 5261 - DNA, 13 bp, Artificial Sequence
  synthetic sequence
ttgacactgcatc

SEQ ID NO: 5262 - DNA, 13 bp, Artificial Sequence
  synthetic sequence
acagtcagtgcat

SEQ ID NO: 5263 - DNA, 13 bp, Artificial Sequence
  synthetic sequence
ggatcagggaaag

SEQ ID NO: 5264 - DNA, 13 bp, Artificial Sequence
  synthetic sequence
gatgaatctttac

SEQ ID NO: 5265 - DNA, 13 bp, Artificial Sequence
  synthetic sequence
atgaaatcctgga

SEQ ID NO: 5266 - DNA, 13 bp, Artificial Sequence
  synthetic sequence
agaatagcaacag

SEQ ID NO: 5267 - DNA, 13 bp, Artificial Sequence
  synthetic sequence
ttgaaggataaca

SEQ ID NO: 5268 - DNA, 13 bp, Artificial Sequence
  synthetic sequence
ctgatgaaggtac

SEQ ID NO: 5269 - DNA, 13 bp, Artificial Sequence
  synthetic sequence
ccacagctgctca

SEQ ID NO: 5270 - DNA, 13 bp, Artificial Sequence
  synthetic sequence
aaagcctaatctg

SEQ ID NO: 5271 - DNA, 13 bp, Artificial Sequence
  synthetic sequence
tggaccggttggt

SEQ ID NO: 5272 - DNA, 13 bp, Artificial Sequence
  synthetic sequence
tgggtaaggatag

SEQ ID NO: 5273 - DNA, 13 bp, Artificial Sequence
  synthetic sequence
agtgcccagcaat

SEQ ID NO: 5274 - DNA, 13 bp, Artificial Sequence
  synthetic sequence
cctaaaggagaca

SEQ ID NO: 5275 - DNA, 13 bp, Artificial Sequence
  synthetic sequence
cctgggccaccag

SEQ ID NO: 5276 - DNA, 13 bp, Artificial Sequence
  synthetic sequence
agaccaccaaccg

SEQ ID NO: 5277 - DNA, 13 bp, Artificial Sequence
  synthetic sequence
ggagacaccggga

SEQ ID NO: 5278 - DNA, 13 bp, Artificial Sequence
  synthetic sequence
tagaccgtagtgc

SEQ ID NO: 5279 - DNA, 13 bp, Artificial Sequence
  synthetic sequence
cctaggcgttgcc

SEQ ID NO: 5280 - DNA, 13 bp, Artificial Sequence
  synthetic sequence
gaacttacctagt

SEQ ID NO: 5281 - DNA, 13 bp, Artificial Sequence
  synthetic sequence
tggaccgattggt

SEQ ID NO: 5282 - DNA, 13 bp, Artificial Sequence
  synthetic sequence
cttatcatgagtt

SEQ ID NO: 5283 - DNA, 13 bp, Artificial Sequence
  synthetic sequence
gcgatctgccgtt

SEQ ID NO: 5284 - DNA, 13 bp, Artificial Sequence
  synthetic sequence
ccagaccaccctg

SEQ ID NO: 5285 - DNA, 13 bp, Artificial Sequence
  synthetic sequence
cctagatcacagt

SEQ ID NO: 5286 - DNA, 13 bp, Artificial Sequence
  synthetic sequence
agtgggcaccgtt

SEQ ID NO: 5287 - DNA, 13 bp, Artificial Sequence
  synthetic sequence
tgacagagatcta

SEQ ID NO: 5288 - DNA, 13 bp, Artificial Sequence
  synthetic sequence
caaatgggggaaa

SEQ ID NO: 5289 - DNA, 13 bp, Artificial Sequence
  synthetic sequence
tcagggaaaggtg

SEQ ID NO: 5290 - DNA, 13 bp, Artificial Sequence
  synthetic sequence
acttaggattcaa

SEQ ID NO: 5291 - DNA, 13 bp, Artificial Sequence
  synthetic sequence
caactccccaccc

SEQ ID NO: 5292 - DNA, 13 bp, Artificial Sequence
  synthetic sequence
gtttacatgcata

SEQ ID NO: 5293 - DNA, 13 bp, Artificial Sequence
  synthetic sequence
ttctgtagaccgc

SEQ ID NO: 5294 - DNA, 13 bp, Artificial Sequence
  synthetic sequence
atccggagaatat

SEQ ID NO: 5295 - DNA, 13 bp, Artificial Sequence
  synthetic sequence
gcacacccctaga

SEQ ID NO: 5296 - DNA, 13 bp, Artificial Sequence
  synthetic sequence
gggccaccagctc

SEQ ID NO: 5297 - DNA, 13 bp, Artificial Sequence
  synthetic sequence
caagcaagcacaa

SEQ ID NO: 5298 - DNA, 13 bp, Artificial Sequence
  synthetic sequence
atcaggattaaga

SEQ ID NO: 5299 - DNA, 13 bp, Artificial Sequence
  synthetic sequence
cggaggcagttgg

SEQ ID NO: 5300 - DNA, 13 bp, Artificial Sequence
  synthetic sequence
ccggacacagacc

SEQ ID NO: 5301 - DNA, 13 bp, Artificial Sequence
  synthetic sequence
tatagagccaaga

SEQ ID NO: 5302 - DNA, 13 bp, Artificial Sequence
  synthetic sequence
taaggaagcaggc

SEQ ID NO: 5303 - DNA, 13 bp, Artificial Sequence
  synthetic sequence
gcactgtatccga

SEQ ID NO: 5304 - DNA, 13 bp, Artificial Sequence
  synthetic sequence
gactatagatgac

SEQ ID NO: 5305 - DNA, 13 bp, Artificial Sequence
  synthetic sequence
cagcaaattcatg

SEQ ID NO: 5306 - DNA, 13 bp, Artificial Sequence
  synthetic sequence
ggattacactgcg

SEQ ID NO: 5307 - DNA, 13 bp, Artificial Sequence
  synthetic sequence
gatagagtcagca

SEQ ID NO: 5308 - DNA, 13 bp, Artificial Sequence
  synthetic sequence
ttctttgttgggt

SEQ ID NO: 5309 - DNA, 13 bp, Artificial Sequence
  synthetic sequence
agttttgtttagt

SEQ ID NO: 5310 - DNA, 13 bp, Artificial Sequence
  synthetic sequence
gcaaatctcttgt

SEQ ID NO: 5311 - DNA, 13 bp, Artificial Sequence
  synthetic sequence
cactttgctccta

SEQ ID NO: 5312 - DNA, 13 bp, Artificial Sequence
  synthetic sequence
aagcatgtctcca

SEQ ID NO: 5313 - DNA, 13 bp, Artificial Sequence
  synthetic sequence
acgggtgatgctc

SEQ ID NO: 5314 - DNA, 13 bp, Artificial Sequence
  synthetic sequence
cattattctggga

SEQ ID NO: 5315 - DNA, 13 bp, Artificial Sequence
  synthetic sequence
ttcgacatctgca

SEQ ID NO: 5316 - DNA, 13 bp, Artificial Sequence
  synthetic sequence
gcctcatcctcca

SEQ ID NO: 5317 - DNA, 13 bp, Artificial Sequence
  synthetic sequence
ctggcatgaaagt

SEQ ID NO: 5318 - DNA, 13 bp, Artificial Sequence
  synthetic sequence
cactccaatgtgt

SEQ ID NO: 5319 - DNA, 13 bp, Artificial Sequence
  synthetic sequence
tgcaatcaggatg

SEQ ID NO: 5320 - DNA, 13 bp, Artificial Sequence
  synthetic sequence
cggcagcaatgta

SEQ ID NO: 5321 - DNA, 13 bp, Artificial Sequence
  synthetic sequence
aatgctcgcccga

SEQ ID NO: 5322 - DNA, 13 bp, Artificial Sequence
  synthetic sequence
ctctcatcagtgg

SEQ ID NO: 5323 - DNA, 13 bp, Artificial Sequence
  synthetic sequence
cttaacgaagata

SEQ ID NO: 5324 - DNA, 13 bp, Artificial Sequence
  synthetic sequence
tgagtatttcact

SEQ ID NO: 5325 - DNA, 13 bp, Artificial Sequence
  synthetic sequence
gcatgacctttca

SEQ ID NO: 5326 - DNA, 13 bp, Artificial Sequence
  synthetic sequence
cgtgagttatccg

SEQ ID NO: 5327 - DNA, 13 bp, Artificial Sequence
  synthetic sequence
ggtcataacctct

SEQ ID NO: 5328 - DNA, 13 bp, Artificial Sequence
  synthetic sequence
gaatcattctctt

SEQ ID NO: 5329 - DNA, 13 bp, Artificial Sequence
  synthetic sequence
gaggcaacatcat

SEQ ID NO: 5330 - DNA, 13 bp, Artificial Sequence
  synthetic sequence
ctttgcctaagaa

SEQ ID NO: 5331 - DNA, 13 bp, Artificial Sequence
  synthetic sequence
gaactgcctgcct

SEQ ID NO: 5332 - DNA, 13 bp, Artificial Sequence
  synthetic sequence
atacatgttgaga

SEQ ID NO: 5333 - DNA, 13 bp, Artificial Sequence
  synthetic sequence
gctgccctaggta

SEQ ID NO: 5334 - DNA, 13 bp, Artificial Sequence
  synthetic sequence
atcatttatgatc

SEQ ID NO: 5335 - DNA, 13 bp, Artificial Sequence
  synthetic sequence
gcttgggctgtaa

SEQ ID NO: 5336 - DNA, 13 bp, Artificial Sequence
  synthetic sequence
agagcagcaagtg

SEQ ID NO: 5337 - DNA, 13 bp, Artificial Sequence
  synthetic sequence
gtggaactgacct

SEQ ID NO: 5338 - DNA, 13 bp, Artificial Sequence
  synthetic sequence
tatggcttcttag

SEQ ID NO: 5339 - DNA, 13 bp, Artificial Sequence
  synthetic sequence
ctgcacatttctc

SEQ ID NO: 5340 - DNA, 13 bp, Artificial Sequence
  synthetic sequence
aagtgagatctct

SEQ ID NO: 5341 - DNA, 13 bp, Artificial Sequence
  synthetic sequence
gttatgaaactat

SEQ ID NO: 5342 - DNA, 13 bp, Artificial Sequence
  synthetic sequence
tccttgatgtcct

SEQ ID NO: 5343 - DNA, 13 bp, Artificial Sequence
  synthetic sequence
cacttgtttagtt

SEQ ID NO: 5344 - DNA, 13 bp, Artificial Sequence
  synthetic sequence
aggtctctatatc

SEQ ID NO: 5345 - DNA, 13 bp, Artificial Sequence
  synthetic sequence
taaagcagtggtt

SEQ ID NO: 5346 - DNA, 13 bp, Artificial Sequence
  synthetic sequence
aggcggtgcttga

SEQ ID NO: 5347 - DNA, 13 bp, Artificial Sequence
  synthetic sequence
ctaatgcctgcaa

SEQ ID NO: 5348 - DNA, 13 bp, Artificial Sequence
  synthetic sequence
tacatagctctgc

SEQ ID NO: 5349 - DNA, 13 bp, Artificial Sequence
  synthetic sequence
caatgatggaggg

SEQ ID NO: 5350 - DNA, 13 bp, Artificial Sequence
  synthetic sequence
cattttgtaagtc

SEQ ID NO: 5351 - DNA, 13 bp, Artificial Sequence
  synthetic sequence
ttaatcttttcag

SEQ ID NO: 5352 - DNA, 13 bp, Artificial Sequence
  synthetic sequence
ttatgactaatga

SEQ ID NO: 5353 - DNA, 13 bp, Artificial Sequence
  synthetic sequence
ttttggtcccttc

SEQ ID NO: 5354 - DNA, 13 bp, Artificial Sequence
  synthetic sequence
tggataggctcta

SEQ ID NO: 5355 - DNA, 13 bp, Artificial Sequence
  synthetic sequence
gggactttgcata

SEQ ID NO: 5356 - DNA, 13 bp, Artificial Sequence
  synthetic sequence
atgcctgatgtct

SEQ ID NO: 5357 - DNA, 13 bp, Artificial Sequence
  synthetic sequence
cccatcttttcga

SEQ ID NO: 5358 - DNA, 13 bp, Artificial Sequence
  synthetic sequence
cttcgtattttca

SEQ ID NO: 5359 - DNA, 13 bp, Artificial Sequence
  synthetic sequence
gaacattgagagt

SEQ ID NO: 5360 - DNA, 13 bp, Artificial Sequence
  synthetic sequence
ctataaacccttt

SEQ ID NO: 5361 - DNA, 13 bp, Artificial Sequence
  synthetic sequence
ttaaatcacaaga

SEQ ID NO: 5362 - DNA, 13 bp, Artificial Sequence
  synthetic sequence
gggaagccggaga

SEQ ID NO: 5363 - DNA, 13 bp, Artificial Sequence
  synthetic sequence
gaattgtgataga

SEQ ID NO: 5364 - DNA, 13 bp, Artificial Sequence
  synthetic sequence
ctctccctggctt

SEQ ID NO: 5365 - DNA, 13 bp, Artificial Sequence
  synthetic sequence
ctgaaatccttga

SEQ ID NO: 5366 - DNA, 13 bp, Artificial Sequence
  synthetic sequence
ccttaatgctcat

SEQ ID NO: 5367 - DNA, 13 bp, Artificial Sequence
  synthetic sequence
catcacttgctct

SEQ ID NO: 5368 - DNA, 13 bp, Artificial Sequence
  synthetic sequence
tgacaaagggctg

SEQ ID NO: 5369 - DNA, 13 bp, Artificial Sequence
  synthetic sequence
ggttgccgtggtc

SEQ ID NO: 5370 - DNA, 13 bp, Artificial Sequence
  synthetic sequence
cgattagatcaca

SEQ ID NO: 5371 - DNA, 13 bp, Artificial Sequence
  synthetic sequence
ggggacattgaga

SEQ ID NO: 5372 - DNA, 13 bp, Artificial Sequence
  synthetic sequence
ttcattttgcaat

SEQ ID NO: 5373 - DNA, 13 bp, Artificial Sequence
  synthetic sequence
ggggatgacgcag

SEQ ID NO: 5374 - DNA, 13 bp, Artificial Sequence
  synthetic sequence
gaattacttgagg

SEQ ID NO: 5375 - DNA, 13 bp, Artificial Sequence
  synthetic sequence
tgatgctggatgc

SEQ ID NO: 5376 - DNA, 13 bp, Artificial Sequence
  synthetic sequence
tgaaatcatgttg

SEQ ID NO: 5377 - DNA, 13 bp, Artificial Sequence
  synthetic sequence
ataacgggatatg

SEQ ID NO: 5378 - DNA, 13 bp, Artificial Sequence
  synthetic sequence
ctcatatttgaga

SEQ ID NO: 5379 - DNA, 13 bp, Artificial Sequence
  synthetic sequence
tggaacgagtcat

SEQ ID NO: 5380 - DNA, 13 bp, Artificial Sequence
  synthetic sequence
ataataccacaat

SEQ ID NO: 5381 - DNA, 13 bp, Artificial Sequence
  synthetic sequence
attctgccgaatt

SEQ ID NO: 5382 - DNA, 13 bp, Artificial Sequence
  synthetic sequence
ggatgttgttctg

SEQ ID NO: 5383 - DNA, 13 bp, Artificial Sequence
  synthetic sequence
tgggcttgatgct

SEQ ID NO: 5384 - DNA, 13 bp, Artificial Sequence
  synthetic sequence
ggtggattgatct

SEQ ID NO: 5385 - DNA, 13 bp, Artificial Sequence
  synthetic sequence
ctaaaaggataaa

SEQ ID NO: 5386 - DNA, 13 bp, Artificial Sequence
  synthetic sequence
gctctcatcttgt

SEQ ID NO: 5387 - DNA, 13 bp, Artificial Sequence
  synthetic sequence
atcagccatcctt

SEQ ID NO: 5388 - DNA, 13 bp, Artificial Sequence
  synthetic sequence
tggaaccaaggcc

SEQ ID NO: 5389 - DNA, 13 bp, Artificial Sequence
  synthetic sequence
agggctcagctgc

SEQ ID NO: 5390 - DNA, 13 bp, Artificial Sequence
  synthetic sequence
ccttacgagatgg

SEQ ID NO: 5391 - DNA, 13 bp, Artificial Sequence
  synthetic sequence
gctgggcctttga

SEQ ID NO: 5392 - DNA, 13 bp, Artificial Sequence
  synthetic sequence
cagcaagctcagt

SEQ ID NO: 5393 - DNA, 13 bp, Artificial Sequence
  synthetic sequence
ctggattctatag

SEQ ID NO: 5394 - DNA, 13 bp, Artificial Sequence
  synthetic sequence
aatcctttttcag

SEQ ID NO: 5395 - DNA, 13 bp, Artificial Sequence
  synthetic sequence
tttgttcacgatt

SEQ ID NO: 5396 - DNA, 13 bp, Artificial Sequence
  synthetic sequence
ctgttgttcttta

SEQ ID NO: 5397 - DNA, 13 bp, Artificial Sequence
  synthetic sequence
tgaagaaggagct

SEQ ID NO: 5398 - DNA, 13 bp, Artificial Sequence
  synthetic sequence
ggtgttgtgtcat

SEQ ID NO: 5399 - DNA, 13 bp, Artificial Sequence
  synthetic sequence
caactgaagagtt

SEQ ID NO: 5400 - DNA, 13 bp, Artificial Sequence
  synthetic sequence
gctgcctccctgg

SEQ ID NO: 5401 - DNA, 13 bp, Artificial Sequence
  synthetic sequence
tatcaggtccatc

SEQ ID NO: 5402 - DNA, 13 bp, Artificial Sequence
  synthetic sequence
aagctacagctaa

SEQ ID NO: 5403 - DNA, 13 bp, Artificial Sequence
  synthetic sequence
ttccatgggcctt

SEQ ID NO: 5404 - DNA, 13 bp, Artificial Sequence
  synthetic sequence
tgaggcagataga

SEQ ID NO: 5405 - DNA, 13 bp, Artificial Sequence
  synthetic sequence
taggaatttcttt

SEQ ID NO: 5406 - DNA, 13 bp, Artificial Sequence
  synthetic sequence
acaggtcggtgct

SEQ ID NO: 5407 - DNA, 13 bp, Artificial Sequence
  synthetic sequence
aatctgtgtttcc

SEQ ID NO: 5408 - DNA, 13 bp, Artificial Sequence
  synthetic sequence
tctatggacagaa

SEQ ID NO: 5409 - DNA, 13 bp, Artificial Sequence
  synthetic sequence
tagctgctttagg

SEQ ID NO: 5410 - DNA, 13 bp, Artificial Sequence
  synthetic sequence
tcagatgtcatca

SEQ ID NO: 5411 - DNA, 13 bp, Artificial Sequence
  synthetic sequence
ttaaggagcctct

SEQ ID NO: 5412 - DNA, 13 bp, Artificial Sequence
  synthetic sequence
aagggtgacatgt

SEQ ID NO: 5413 - DNA, 13 bp, Artificial Sequence
  synthetic sequence
gatatgtgagggg

SEQ ID NO: 5414 - DNA, 13 bp, Artificial Sequence
  synthetic sequence
agcagagaaatgt

SEQ ID NO: 5415 - DNA, 13 bp, Artificial Sequence
  synthetic sequence
atgatagtgtcta

SEQ ID NO: 5416 - DNA, 13 bp, Artificial Sequence
  synthetic sequence
ttccaacatttga

SEQ ID NO: 5417 - DNA, 13 bp, Artificial Sequence
  synthetic sequence
catctaaatatgg

SEQ ID NO: 5418 - DNA, 13 bp, Artificial Sequence
  synthetic sequence
gctcacaccccac

SEQ ID NO: 5419 - DNA, 13 bp, Artificial Sequence
  synthetic sequence
gtcatcagactga

SEQ ID NO: 5420 - DNA, 13 bp, Artificial Sequence
  synthetic sequence
tgcatatttgttt

SEQ ID NO: 5421 - DNA, 13 bp, Artificial Sequence
  synthetic sequence
aaaaatgaaaggg

SEQ ID NO: 5422 - DNA, 13 bp, Artificial Sequence
  synthetic sequence
tgcatagtgtgtg

SEQ ID NO: 5423 - DNA, 13 bp, Artificial Sequence
  synthetic sequence
taggatggatgga

SEQ ID NO: 5424 - DNA, 13 bp, Artificial Sequence
  synthetic sequence
agttggtttggag

SEQ ID NO: 5425 - DNA, 13 bp, Artificial Sequence
  synthetic sequence
agggtatgcaatt

SEQ ID NO: 5426 - DNA, 13 bp, Artificial Sequence
  synthetic sequence
ttgtccgatcaac

SEQ ID NO: 5427 - DNA, 13 bp, Artificial Sequence
  synthetic sequence
aagaagtgcactg

SEQ ID NO: 5428 - DNA, 13 bp, Artificial Sequence
  synthetic sequence
agacaaggaatga

SEQ ID NO: 5429 - DNA, 13 bp, Artificial Sequence
  synthetic sequence
aaagccatcattg

SEQ ID NO: 5430 - DNA, 13 bp, Artificial Sequence
  synthetic sequence
gtgatgaagacac

SEQ ID NO: 5431 - DNA, 13 bp, Artificial Sequence
  synthetic sequence
gtggaggatgggg

SEQ ID NO: 5432 - DNA, 13 bp, Artificial Sequence
  synthetic sequence
ctctgcatatagt

SEQ ID NO: 5433 - DNA, 13 bp, Artificial Sequence
  synthetic sequence
atctcagaaacag

SEQ ID NO: 5434 - DNA, 13 bp, Artificial Sequence
  synthetic sequence
aagggggtcaagg

SEQ ID NO: 5435 - DNA, 13 bp, Artificial Sequence
  synthetic sequence
acaaagacggtgc

SEQ ID NO: 5436 - DNA, 13 bp, Artificial Sequence
  synthetic sequence
aaaccaagttctt

SEQ ID NO: 5437 - DNA, 13 bp, Artificial Sequence
  synthetic sequence
gaccagggaaggg

SEQ ID NO: 5438 - DNA, 13 bp, Artificial Sequence
  synthetic sequence
ggttattagagtg

SEQ ID NO: 5439 - DNA, 13 bp, Artificial Sequence
  synthetic sequence
ggaccaaacaaag

SEQ ID NO: 5440 - DNA, 13 bp, Artificial Sequence
  synthetic sequence
gcttcaatgtgaa

SEQ ID NO: 5441 - DNA, 13 bp, Artificial Sequence
  synthetic sequence
gggacaaaagatc

SEQ ID NO: 5442 - DNA, 13 bp, Artificial Sequence
  synthetic sequence
aaagagaaactcg

SEQ ID NO: 5443 - DNA, 13 bp, Artificial Sequence
  synthetic sequence
agccaggaattat

SEQ ID NO: 5444 - DNA, 13 bp, Artificial Sequence
  synthetic sequence
ccctagtgcttat

SEQ ID NO: 5445 - DNA, 13 bp, Artificial Sequence
  synthetic sequence
tgatggggagaaa

SEQ ID NO: 5446 - DNA, 13 bp, Artificial Sequence
  synthetic sequence
ctcctcttctcat

SEQ ID NO: 5447 - DNA, 13 bp, Artificial Sequence
  synthetic sequence
cttggagactttg

SEQ ID NO: 5448 - DNA, 13 bp, Artificial Sequence
  synthetic sequence
actcctttgttgg

SEQ ID NO: 5449 - DNA, 13 bp, Artificial Sequence
  synthetic sequence
ggtatgcagggga

SEQ ID NO: 5450 - DNA, 13 bp, Artificial Sequence
  synthetic sequence
cgtccatggttgt

SEQ ID NO: 5451 - DNA, 13 bp, Artificial Sequence
  synthetic sequence
gactttgcatcaa

SEQ ID NO: 5452 - DNA, 13 bp, Artificial Sequence
  synthetic sequence
atgatctagagga

SEQ ID NO: 5453 - DNA, 13 bp, Artificial Sequence
  synthetic sequence
aaagctttcaaga

SEQ ID NO: 5454 - DNA, 13 bp, Artificial Sequence
  synthetic sequence
gtagcactatgct

SEQ ID NO: 5455 - DNA, 13 bp, Artificial Sequence
  synthetic sequence
tcacccagcagtt

SEQ ID NO: 5456 - DNA, 13 bp, Artificial Sequence
  synthetic sequence
tctgggcctgttc

SEQ ID NO: 5457 - DNA, 13 bp, Artificial Sequence
  synthetic sequence
ggaagctgattag

SEQ ID NO: 5458 - DNA, 13 bp, Artificial Sequence
  synthetic sequence
catccttcttctt

SEQ ID NO: 5459 - DNA, 13 bp, Artificial Sequence
  synthetic sequence
gatccatcacaaa

SEQ ID NO: 5460 - DNA, 13 bp, Artificial Sequence
  synthetic sequence
ggttgtcttctgc

SEQ ID NO: 5461 - DNA, 13 bp, Artificial Sequence
  synthetic sequence
acacaggcccctt

SEQ ID NO: 5462 - DNA, 13 bp, Artificial Sequence
  synthetic sequence
gaacctcatactt

SEQ ID NO: 5463 - DNA, 13 bp, Artificial Sequence
  synthetic sequence
aactcatgcattc

SEQ ID NO: 5464 - DNA, 13 bp, Artificial Sequence
  synthetic sequence
aattttctttagc

SEQ ID NO: 5465 - DNA, 13 bp, Artificial Sequence
  synthetic sequence
gaataatatatct

SEQ ID NO: 5466 - DNA, 13 bp, Artificial Sequence
  synthetic sequence
tgaccaatttatt

SEQ ID NO: 5467 - DNA, 13 bp, Artificial Sequence
  synthetic sequence
ggcttttgctgga

SEQ ID NO: 5468 - DNA, 13 bp, Artificial Sequence
  synthetic sequence
ctgaagtcattag

SEQ ID NO: 5469 - DNA, 13 bp, Artificial Sequence
  synthetic sequence
ctctccccatctt

SEQ ID NO: 5470 - DNA, 13 bp, Artificial Sequence
  synthetic sequence
tctttccctcaga

SEQ ID NO: 5471 - DNA, 13 bp, Artificial Sequence
  synthetic sequence
gcaaatcagttct

SEQ ID NO: 5472 - DNA, 13 bp, Artificial Sequence
  synthetic sequence
ctttatcacaaga

SEQ ID NO: 5473 - DNA, 13 bp, Artificial Sequence
  synthetic sequence
atgcattgttctt

SEQ ID NO: 5474 - DNA, 13 bp, Artificial Sequence
  synthetic sequence
cccatgtatgagg

SEQ ID NO: 5475 - DNA, 13 bp, Artificial Sequence
  synthetic sequence
ctgtctcctcata

SEQ ID NO: 5476 - DNA, 13 bp, Artificial Sequence
  synthetic sequence
ctctatggtatct

SEQ ID NO: 5477 - DNA, 13 bp, Artificial Sequence
  synthetic sequence
gggcatccaaatg

SEQ ID NO: 5478 - DNA, 13 bp, Artificial Sequence
  synthetic sequence
caactccataata

SEQ ID NO: 5479 - DNA, 13 bp, Artificial Sequence
  synthetic sequence
gaaagtgcttgag

SEQ ID NO: 5480 - DNA, 13 bp, Artificial Sequence
  synthetic sequence
tttcagctgacac

SEQ ID NO: 5481 - DNA, 13 bp, Artificial Sequence
  synthetic sequence
aaccccataatag

SEQ ID NO: 5482 - DNA, 13 bp, Artificial Sequence
  synthetic sequence
ccgccacatctgt

SEQ ID NO: 5483 - DNA, 13 bp, Artificial Sequence
  synthetic sequence
tgtcctttactcc

SEQ ID NO: 5484 - DNA, 13 bp, Artificial Sequence
  synthetic sequence
tcctgaatgaatg

SEQ ID NO: 5485 - DNA, 13 bp, Artificial Sequence
  synthetic sequence
gaccgcccaatat

SEQ ID NO: 5486 - DNA, 13 bp, Artificial Sequence
  synthetic sequence
ctctgggctgcca

SEQ ID NO: 5487 - DNA, 13 bp, Artificial Sequence
  synthetic sequence
cattgctgcagag

SEQ ID NO: 5488 - DNA, 13 bp, Artificial Sequence
  synthetic sequence
caaagaccggtgc

SEQ ID NO: 5489 - DNA, 13 bp, Artificial Sequence
  synthetic sequence
ttgtgcaaggctc

SEQ ID NO: 5490 - DNA, 13 bp, Artificial Sequence
  synthetic sequence
cagcctttgcaat

SEQ ID NO: 5491 - DNA, 13 bp, Artificial Sequence
  synthetic sequence
aaccagtcaaaga

SEQ ID NO: 5492 - DNA, 13 bp, Artificial Sequence
  synthetic sequence
ttcctgtggatgt

SEQ ID NO: 5493 - DNA, 13 bp, Artificial Sequence
  synthetic sequence
ccaacaaatgaaa

SEQ ID NO: 5494 - DNA, 13 bp, Artificial Sequence
  synthetic sequence
ccagtgagaggct

SEQ ID NO: 5495 - DNA, 13 bp, Artificial Sequence
  synthetic sequence
catcatcctcact

SEQ ID NO: 5496 - DNA, 13 bp, Artificial Sequence
  synthetic sequence
tgccaaagcaaaa

SEQ ID NO: 5497 - DNA, 13 bp, Artificial Sequence
  synthetic sequence
atgctgtgccaga

SEQ ID NO: 5498 - DNA, 13 bp, Artificial Sequence
  synthetic sequence
tgagctccctctt

SEQ ID NO: 5499 - DNA, 13 bp, Artificial Sequence
  synthetic sequence
gcaaccatcttct

SEQ ID NO: 5500 - DNA, 13 bp, Artificial Sequence
  synthetic sequence
actattttggagc

SEQ ID NO: 5501 - DNA, 13 bp, Artificial Sequence
  synthetic sequence
tcaatcagatttg

SEQ ID NO: 5502 - DNA, 13 bp, Artificial Sequence
  synthetic sequence
cctatctgtacaa

SEQ ID NO: 5503 - DNA, 13 bp, Artificial Sequence
  synthetic sequence
acaatatttacat

SEQ ID NO: 5504 - DNA, 13 bp, Artificial Sequence
  synthetic sequence
ccctctcaaagac

SEQ ID NO: 5505 - DNA, 13 bp, Artificial Sequence
  synthetic sequence
tgctgcctcaccc

SEQ ID NO: 5506 - DNA, 13 bp, Artificial Sequence
  synthetic sequence
ctgccactctggc

SEQ ID NO: 5507 - DNA, 13 bp, Artificial Sequence
  synthetic sequence
gcttatctgtaca

SEQ ID NO: 5508 - DNA, 13 bp, Artificial Sequence
  synthetic sequence
gggcagtgagcta

SEQ ID NO: 5509 - DNA, 13 bp, Artificial Sequence
  synthetic sequence
tatcaaagctttt

SEQ ID NO: 5510 - DNA, 13 bp, Artificial Sequence
  synthetic sequence
gccacattttaga

SEQ ID NO: 5511 - DNA, 13 bp, Artificial Sequence
  synthetic sequence
cacaaagctccct

SEQ ID NO: 5512 - DNA, 13 bp, Artificial Sequence
  synthetic sequence
ggatgatgatgaa

SEQ ID NO: 5513 - DNA, 13 bp, Artificial Sequence
  synthetic sequence
tcattgctagagt

SEQ ID NO: 5514 - DNA, 13 bp, Artificial Sequence
  synthetic sequence
tctcctccataag

SEQ ID NO: 5515 - DNA, 13 bp, Artificial Sequence
  synthetic sequence
tttgctggcatgg

SEQ ID NO: 5516 - DNA, 13 bp, Artificial Sequence
  synthetic sequence
ctgtcatggcagc

SEQ ID NO: 5517 - DNA, 13 bp, Artificial Sequence
  synthetic sequence
tcagctgctgtca

SEQ ID NO: 5518 - DNA, 13 bp, Artificial Sequence
  synthetic sequence
cccttctctacca

SEQ ID NO: 5519 - DNA, 13 bp, Artificial Sequence
  synthetic sequence
gtccgagagtttg

SEQ ID NO: 5520 - DNA, 13 bp, Artificial Sequence
  synthetic sequence
tgtttgtgaggat

SEQ ID NO: 5521 - DNA, 13 bp, Artificial Sequence
  synthetic sequence
tgtttgagaatgg

SEQ ID NO: 5522 - DNA, 13 bp, Artificial Sequence
  synthetic sequence
tggatggaagaca

SEQ ID NO: 5523 - DNA, 13 bp, Artificial Sequence
  synthetic sequence
ccatcattgagct

SEQ ID NO: 5524 - DNA, 13 bp, Artificial Sequence
  synthetic sequence
aacagatcactgt

SEQ ID NO: 5525 - DNA, 13 bp, Artificial Sequence
  synthetic sequence
caaatgtgggaag

SEQ ID NO: 5526 - DNA, 13 bp, Artificial Sequence
  synthetic sequence
gaagaccactggc

SEQ ID NO: 5527 - DNA, 13 bp, Artificial Sequence
  synthetic sequence
cccgcgtgttgtc

SEQ ID NO: 5528 - DNA, 13 bp, Artificial Sequence
  synthetic sequence
accttggatgtgg

SEQ ID NO: 5529 - DNA, 13 bp, Artificial Sequence
  synthetic sequence
tggaggaacagag

SEQ ID NO: 5530 - DNA, 13 bp, Artificial Sequence
  synthetic sequence
tgggtgccatgtt

SEQ ID NO: 5531 - DNA, 13 bp, Artificial Sequence
  synthetic sequence
tggtgctgcagga

SEQ ID NO: 5532 - DNA, 13 bp, Artificial Sequence
  synthetic sequence
acggtttggtttg

SEQ ID NO: 5533 - DNA, 13 bp, Artificial Sequence
  synthetic sequence
tgatgaccatggg

SEQ ID NO: 5534 - DNA, 13 bp, Artificial Sequence
  synthetic sequence
ttgggggcattac

SEQ ID NO: 5535 - DNA, 13 bp, Artificial Sequence
  synthetic sequence
ctgaggttgaaga

SEQ ID NO: 5536 - DNA, 13 bp, Artificial Sequence
  synthetic sequence
tcaacaggacttt

SEQ ID NO: 5537 - DNA, 13 bp, Artificial Sequence
  synthetic sequence
gccagggtgtact

SEQ ID NO: 5538 - DNA, 13 bp, Artificial Sequence
  synthetic sequence
tacaggatcatga

SEQ ID NO: 5539 - DNA, 13 bp, Artificial Sequence
  synthetic sequence
ctctcacgtttct

SEQ ID NO: 5540 - DNA, 13 bp, Artificial Sequence
  synthetic sequence
acagaaggagaag

SEQ ID NO: 5541 - DNA, 13 bp, Artificial Sequence
  synthetic sequence
actgtggagtcgc

SEQ ID NO: 5542 - DNA, 13 bp, Artificial Sequence
  synthetic sequence
ccaccaaagctgc

SEQ ID NO: 5543 - DNA, 13 bp, Artificial Sequence
  synthetic sequence
agtctggaagcag

SEQ ID NO: 5544 - DNA, 13 bp, Artificial Sequence
  synthetic sequence
gactgttggtgca

SEQ ID NO: 5545 - DNA, 13 bp, Artificial Sequence
  synthetic sequence
tggcagccaacga

SEQ ID NO: 5546 - DNA, 13 bp, Artificial Sequence
  synthetic sequence
tcaatggagtggt

SEQ ID NO: 5547 - DNA, 13 bp, Artificial Sequence
  synthetic sequence
ccatggatgggga

SEQ ID NO: 5548 - DNA, 13 bp, Artificial Sequence
  synthetic sequence
aggctgatgtctc

SEQ ID NO: 5549 - DNA, 13 bp, Artificial Sequence
  synthetic sequence
tgggaaagtgatg

SEQ ID NO: 5550 - DNA, 13 bp, Artificial Sequence
  synthetic sequence
gaggattttggat

SEQ ID NO: 5551 - DNA, 13 bp, Artificial Sequence
  synthetic sequence
tgtggggcgatgg

SEQ ID NO: 5552 - DNA, 13 bp, Artificial Sequence
  synthetic sequence
gtgttggaattgc

SEQ ID NO: 5553 - DNA, 13 bp, Artificial Sequence
  synthetic sequence
ctgatgtgttgaa

SEQ ID NO: 5554 - DNA, 13 bp, Artificial Sequence
  synthetic sequence
gcaacaccatgca

SEQ ID NO: 5555 - DNA, 13 bp, Artificial Sequence
  synthetic sequence
taaagaacatgga

SEQ ID NO: 5556 - DNA, 13 bp, Artificial Sequence
  synthetic sequence
cgcgaggcttccc

SEQ ID NO: 5557 - DNA, 13 bp, Artificial Sequence
  synthetic sequence
gagcgcaccacac

SEQ ID NO: 5558 - DNA, 13 bp, Artificial Sequence
  synthetic sequence
aaaggacctggaa

SEQ ID NO: 5559 - DNA, 13 bp, Artificial Sequence
  synthetic sequence
gtggtggaacctg

SEQ ID NO: 5560 - DNA, 13 bp, Artificial Sequence
  synthetic sequence
atgattggcctga

SEQ ID NO: 5561 - DNA, 13 bp, Artificial Sequence
  synthetic sequence
aggtgcttctggg

SEQ ID NO: 5562 - DNA, 13 bp, Artificial Sequence
  synthetic sequence
tcacagggtgccg

SEQ ID NO: 5563 - DNA, 13 bp, Artificial Sequence
  synthetic sequence
gactgctggtgca

SEQ ID NO: 5564 - DNA, 13 bp, Artificial Sequence
  synthetic sequence
ccatggacgggga

SEQ ID NO: 5565 - DNA, 13 bp, Artificial Sequence
  synthetic sequence
gtgtactcagacc

SEQ ID NO: 5566 - DNA, 13 bp, Artificial Sequence
  synthetic sequence
gtggggtgatgga

SEQ ID NO: 5567 - DNA, 13 bp, Artificial Sequence
  synthetic sequence
gtgttggaactgc

SEQ ID NO: 5568 - DNA, 13 bp, Artificial Sequence
  synthetic sequence
ttgggggtattac

SEQ ID NO: 5569 - DNA, 13 bp, Artificial Sequence
  synthetic sequence
aaaacgtccagac

SEQ ID NO: 5570 - DNA, 13 bp, Artificial Sequence
  synthetic sequence
gctatgctgagtc

SEQ ID NO: 5571 - DNA, 13 bp, Artificial Sequence
  synthetic sequence
gccaatgaaatgg

SEQ ID NO: 5572 - DNA, 13 bp, Artificial Sequence
  synthetic sequence
ggaagcaacacaa

SEQ ID NO: 5573 - DNA, 13 bp, Artificial Sequence
  synthetic sequence
gaagaacaccgca

SEQ ID NO: 5574 - DNA, 13 bp, Artificial Sequence
  synthetic sequence
gtcatgcagaaaa

SEQ ID NO: 5575 - DNA, 13 bp, Artificial Sequence
  synthetic sequence
ttgggctgatcgc

SEQ ID NO: 5576 - DNA, 13 bp, Artificial Sequence
  synthetic sequence
atggaagagtcat

SEQ ID NO: 5577 - DNA, 13 bp, Artificial Sequence
  synthetic sequence
tggagtttgaaga

SEQ ID NO: 5578 - DNA, 13 bp, Artificial Sequence
  synthetic sequence
acgtccaagccag

SEQ ID NO: 5579 - DNA, 13 bp, Artificial Sequence
  synthetic sequence
ggataactgagta

SEQ ID NO: 5580 - DNA, 13 bp, Artificial Sequence
  synthetic sequence
tgcaaaggaaagg

SEQ ID NO: 5581 - DNA, 13 bp, Artificial Sequence
  synthetic sequence
caggagtgttcaa

SEQ ID NO: 5582 - DNA, 13 bp, Artificial Sequence
  synthetic sequence
ggagcgatgtttg

SEQ ID NO: 5583 - DNA, 13 bp, Artificial Sequence
  synthetic sequence
atgggaagtgcct

SEQ ID NO: 5584 - DNA, 13 bp, Artificial Sequence
  synthetic sequence
gcacaaatctggg

SEQ ID NO: 5585 - DNA, 13 bp, Artificial Sequence
  synthetic sequence
ttgtggatctcgg

SEQ ID NO: 5586 - DNA, 13 bp, Artificial Sequence
  synthetic sequence
tgcaccctccctc

SEQ ID NO: 5587 - DNA, 13 bp, Artificial Sequence
  synthetic sequence
cttgtgaatgggg

SEQ ID NO: 5588 - DNA, 13 bp, Artificial Sequence
  synthetic sequence
cggttggaggagt

SEQ ID NO: 5589 - DNA, 13 bp, Artificial Sequence
  synthetic sequence
ggaacagtatgga

SEQ ID NO: 5590 - DNA, 13 bp, Artificial Sequence
  synthetic sequence
caggcctcaagag

SEQ ID NO: 5591 - DNA, 13 bp, Artificial Sequence
  synthetic sequence
gttgaatctcatg

SEQ ID NO: 5592 - DNA, 13 bp, Artificial Sequence
  synthetic sequence
tagcttcggtcag

SEQ ID NO: 5593 - DNA, 13 bp, Artificial Sequence
  synthetic sequence
tctccaggggctg

SEQ ID NO: 5594 - DNA, 13 bp, Artificial Sequence
  synthetic sequence
gcgtttacagaat

SEQ ID NO: 5595 - DNA, 13 bp, Artificial Sequence
  synthetic sequence
tcacaggctctag

SEQ ID NO: 5596 - DNA, 13 bp, Artificial Sequence
  synthetic sequence
gctttctggagtt

SEQ ID NO: 5597 - DNA, 13 bp, Artificial Sequence
  synthetic sequence
cacagcaattgct

SEQ ID NO: 5598 - DNA, 13 bp, Artificial Sequence
  synthetic sequence
gtttcttagcacg

SEQ ID NO: 5599 - DNA, 13 bp, Artificial Sequence
  synthetic sequence
gtgaaggacgagc

SEQ ID NO: 5600 - DNA, 13 bp, Artificial Sequence
  synthetic sequence
gaggaggaaagac

SEQ ID NO: 5601 - DNA, 13 bp, Artificial Sequence
  synthetic sequence
cctgtgtgagctg

SEQ ID NO: 5602 - DNA, 13 bp, Artificial Sequence
  synthetic sequence
acacccatcatgc

SEQ ID NO: 5603 - DNA, 13 bp, Artificial Sequence
  synthetic sequence
ctgagatgctgag

SEQ ID NO: 5604 - DNA, 13 bp, Artificial Sequence
  synthetic sequence
cactattcacact

SEQ ID NO: 5605 - DNA, 13 bp, Artificial Sequence
  synthetic sequence
tccataacatgga

SEQ ID NO: 5606 - DNA, 13 bp, Artificial Sequence
  synthetic sequence
ttgtgtttgtcgt

SEQ ID NO: 5607 - DNA, 13 bp, Artificial Sequence
  synthetic sequence
gggagatccctga

SEQ ID NO: 5608 - DNA, 13 bp, Artificial Sequence
  synthetic sequence
accattggcacaa

SEQ ID NO: 5609 - DNA, 13 bp, Artificial Sequence
  synthetic sequence
atagaggagaatg

SEQ ID NO: 5610 - DNA, 13 bp, Artificial Sequence
  synthetic sequence
agaatcgcgcttg

SEQ ID NO: 5611 - DNA, 13 bp, Artificial Sequence
  synthetic sequence
gaaagagttgatg

SEQ ID NO: 5612 - DNA, 13 bp, Artificial Sequence
  synthetic sequence
tgtgaacaaacaa

SEQ ID NO: 5613 - DNA, 13 bp, Artificial Sequence
  synthetic sequence
gagctcacatacc

SEQ ID NO: 5614 - DNA, 13 bp, Artificial Sequence
  synthetic sequence
gtgacttgataat

SEQ ID NO: 5615 - DNA, 13 bp, Artificial Sequence
  synthetic sequence
tcctctcaaaacc

SEQ ID NO: 5616 - DNA, 13 bp, Artificial Sequence
  synthetic sequence
ccatggatggaga

SEQ ID NO: 5617 - DNA, 13 bp, Artificial Sequence
  synthetic sequence
agggggacacgac

SEQ ID NO: 5618 - DNA, 13 bp, Artificial Sequence
  synthetic sequence
agatgggttggct

SEQ ID NO: 5619 - DNA, 13 bp, Artificial Sequence
  synthetic sequence
gtcagcgatctct

SEQ ID NO: 5620 - DNA, 13 bp, Artificial Sequence
  synthetic sequence
taggcagagctcg

SEQ ID NO: 5621 - DNA, 13 bp, Artificial Sequence
  synthetic sequence
gacacaggtcacg

SEQ ID NO: 5622 - DNA, 13 bp, Artificial Sequence
  synthetic sequence
tacgaatggatca

SEQ ID NO: 5623 - DNA, 13 bp, Artificial Sequence
  synthetic sequence
ctactccacacag

SEQ ID NO: 5624 - DNA, 13 bp, Artificial Sequence
  synthetic sequence
agcggaagggcat

SEQ ID NO: 5625 - DNA, 13 bp, Artificial Sequence
  synthetic sequence
accaggagggccc

SEQ ID NO: 5626 - DNA, 13 bp, Artificial Sequence
  synthetic sequence
atttgtgttggct

SEQ ID NO: 5627 - DNA, 13 bp, Artificial Sequence
  synthetic sequence
atcgtcacaaagt

SEQ ID NO: 5628 - DNA, 13 bp, Artificial Sequence
  synthetic sequence
tgatcctgggaga

SEQ ID NO: 5629 - DNA, 13 bp, Artificial Sequence
  synthetic sequence
gcatggctgtcag

SEQ ID NO: 5630 - DNA, 13 bp, Artificial Sequence
  synthetic sequence
cttgctgctggac

SEQ ID NO: 5631 - DNA, 13 bp, Artificial Sequence
  synthetic sequence
gcaccaaatgtgg

SEQ ID NO: 5632 - DNA, 13 bp, Artificial Sequence
  synthetic sequence
caccttaccacca

SEQ ID NO: 5633 - DNA, 13 bp, Artificial Sequence
  synthetic sequence
ctagtcctggtgt

SEQ ID NO: 5634 - DNA, 13 bp, Artificial Sequence
  synthetic sequence
tgaccagccaggt

SEQ ID NO: 5635 - DNA, 13 bp, Artificial Sequence
  synthetic sequence
tacgtcaggtatg

SEQ ID NO: 5636 - DNA, 13 bp, Artificial Sequence
  synthetic sequence
tggaacggtggtg

SEQ ID NO: 5637 - DNA, 13 bp, Artificial Sequence
  synthetic sequence
agaacgttaagaa

SEQ ID NO: 5638 - DNA, 13 bp, Artificial Sequence
  synthetic sequence
caggcagcaccgt

SEQ ID NO: 5639 - DNA, 13 bp, Artificial Sequence
  synthetic sequence
gtccacctcttgc

SEQ ID NO: 5640 - DNA, 13 bp, Artificial Sequence
  synthetic sequence
gccacatgaacca

SEQ ID NO: 5641 - DNA, 13 bp, Artificial Sequence
  synthetic sequence
cccatccacaaca

SEQ ID NO: 5642 - DNA, 13 bp, Artificial Sequence
  synthetic sequence
acatgacatcaac

SEQ ID NO: 5643 - DNA, 13 bp, Artificial Sequence
  synthetic sequence
tccacatacttct

SEQ ID NO: 5644 - DNA, 13 bp, Artificial Sequence
  synthetic sequence
cattcataagtga

SEQ ID NO: 5645 - DNA, 13 bp, Artificial Sequence
  synthetic sequence
gcatgttgatgtt

SEQ ID NO: 5646 - DNA, 13 bp, Artificial Sequence
  synthetic sequence
ctcctctctttgt

SEQ ID NO: 5647 - DNA, 13 bp, Artificial Sequence
  synthetic sequence
caaaggtgttgtt

SEQ ID NO: 5648 - DNA, 13 bp, Artificial Sequence
  synthetic sequence
gttgttcccttca

SEQ ID NO: 5649 - DNA, 13 bp, Artificial Sequence
  synthetic sequence
aagccatttgaaa

SEQ ID NO: 5650 - DNA, 13 bp, Artificial Sequence
  synthetic sequence
catgatttgactt

SEQ ID NO: 5651 - DNA, 13 bp, Artificial Sequence
  synthetic sequence
gctcctttctttt

SEQ ID NO: 5652 - DNA, 13 bp, Artificial Sequence
  synthetic sequence
ttcgtgatgactt

SEQ ID NO: 5653 - DNA, 13 bp, Artificial Sequence
  synthetic sequence
ttgtcatccactc

SEQ ID NO: 5654 - DNA, 13 bp, Artificial Sequence
  synthetic sequence
gttgttctcctct

SEQ ID NO: 5655 - DNA, 13 bp, Artificial Sequence
  synthetic sequence
aaccactcacgat

SEQ ID NO: 5656 - DNA, 13 bp, Artificial Sequence
  synthetic sequence
tctcaatccacat

SEQ ID NO: 5657 - DNA, 13 bp, Artificial Sequence
  synthetic sequence
tccatcctttcac

SEQ ID NO: 5658 - DNA, 13 bp, Artificial Sequence
  synthetic sequence
ctccgatgtcaca

SEQ ID NO: 5659 - DNA, 13 bp, Artificial Sequence
  synthetic sequence
ccaacccccacgc

SEQ ID NO: 5660 - DNA, 13 bp, Artificial Sequence
  synthetic sequence
cttccatctttca

SEQ ID NO: 5661 - DNA, 13 bp, Artificial Sequence
  synthetic sequence
atcaccctgctcg

SEQ ID NO: 5662 - DNA, 13 bp, Artificial Sequence
  synthetic sequence
ggcagttcctcca

SEQ ID NO: 5663 - DNA, 13 bp, Artificial Sequence
  synthetic sequence
ccgcacactcctt

SEQ ID NO: 5664 - DNA, 13 bp, Artificial Sequence
  synthetic sequence
ccatccactacag

SEQ ID NO: 5665 - DNA, 13 bp, Artificial Sequence
  synthetic sequence
caaatcaggaaca

SEQ ID NO: 5666 - DNA, 13 bp, Artificial Sequence
  synthetic sequence
tagttccaggttc

SEQ ID NO: 5667 - DNA, 13 bp, Artificial Sequence
  synthetic sequence
ctagagactggat

SEQ ID NO: 5668 - DNA, 13 bp, Artificial Sequence
  synthetic sequence
gtttctccacatc

SEQ ID NO: 5669 - DNA, 13 bp, Artificial Sequence
  synthetic sequence
atgtaatctgacg

SEQ ID NO: 5670 - DNA, 13 bp, Artificial Sequence
  synthetic sequence
cctctgccaggtt

SEQ ID NO: 5671 - DNA, 13 bp, Artificial Sequence
  synthetic sequence
agacgccgatgtt

SEQ ID NO: 5672 - DNA, 13 bp, Artificial Sequence
  synthetic sequence
tccgggatctcag

SEQ ID NO: 5673 - DNA, 13 bp, Artificial Sequence
  synthetic sequence
ctttccgctctct

SEQ ID NO: 5674 - DNA, 13 bp, Artificial Sequence
  synthetic sequence
cctctcgagagca

SEQ ID NO: 5675 - DNA, 13 bp, Artificial Sequence
  synthetic sequence
accagggcatatc

SEQ ID NO: 5676 - DNA, 13 bp, Artificial Sequence
  synthetic sequence
acctcatcctgcc

SEQ ID NO: 5677 - DNA, 13 bp, Artificial Sequence
  synthetic sequence
cccaatacatctc

SEQ ID NO: 5678 - DNA, 13 bp, Artificial Sequence
  synthetic sequence
ccacttcgtactt

SEQ ID NO: 5679 - DNA, 13 bp, Artificial Sequence
  synthetic sequence
ttgagctccgccg

SEQ ID NO: 5680 - DNA, 13 bp, Artificial Sequence
  synthetic sequence
cccagtacatctc

SEQ ID NO: 5681 - DNA, 13 bp, Artificial Sequence
  synthetic sequence
tcatacttgatgt

SEQ ID NO: 5682 - DNA, 13 bp, Artificial Sequence
  synthetic sequence
ctctcgatccaca

SEQ ID NO: 5683 - DNA, 13 bp, Artificial Sequence
  synthetic sequence
catttttcatgat

SEQ ID NO: 5684 - DNA, 13 bp, Artificial Sequence
  synthetic sequence
tctccaatgtcac

SEQ ID NO: 5685 - DNA, 13 bp, Artificial Sequence
  synthetic sequence
tcatccattctcc

SEQ ID NO: 5686 - DNA, 13 bp, Artificial Sequence
  synthetic sequence
tgttgatgtagtc

SEQ ID NO: 5687 - DNA, 13 bp, Artificial Sequence
  synthetic sequence
ttcatgatcagtt

SEQ ID NO: 5688 - DNA, 13 bp, Artificial Sequence
  synthetic sequence
ctgctccatggca

SEQ ID NO: 5689 - DNA, 13 bp, Artificial Sequence
  synthetic sequence
tccaggctctgtc

SEQ ID NO: 5690 - DNA, 13 bp, Artificial Sequence
  synthetic sequence
cttccattctctc

SEQ ID NO: 5691 - DNA, 13 bp, Artificial Sequence
  synthetic sequence
cactctcagtggt

SEQ ID NO: 5692 - DNA, 13 bp, Artificial Sequence
  synthetic sequence
gcatccatccaat

SEQ ID NO: 5693 - DNA, 13 bp, Artificial Sequence
  synthetic sequence
cctcttcccacca

SEQ ID NO: 5694 - DNA, 13 bp, Artificial Sequence
  synthetic sequence
cttccatgttcat

SEQ ID NO: 5695 - DNA, 13 bp, Artificial Sequence
  synthetic sequence
tcttttgttttgt

SEQ ID NO: 5696 - DNA, 13 bp, Artificial Sequence
  synthetic sequence
ccatcctcctcgc

SEQ ID NO: 5697 - DNA, 13 bp, Artificial Sequence
  synthetic sequence
tcacttcatagct

SEQ ID NO: 5698 - DNA, 13 bp, Artificial Sequence
  synthetic sequence
agttcaagaacct

SEQ ID NO: 5699 - DNA, 13 bp, Artificial Sequence
  synthetic sequence
ggacctcatcatg

SEQ ID NO: 5700 - DNA, 13 bp, Artificial Sequence
  synthetic sequence
ccactaaccaccg

SEQ ID NO: 5701 - DNA, 13 bp, Artificial Sequence
  synthetic sequence
ggccttttccttt

SEQ ID NO: 5702 - DNA, 13 bp, Artificial Sequence
  synthetic sequence
ctgcatgtgcttt

SEQ ID NO: 5703 - DNA, 13 bp, Artificial Sequence
  synthetic sequence
attgtctgaaggg

SEQ ID NO: 5704 - DNA, 13 bp, Artificial Sequence
  synthetic sequence
cacatcctgggtt

SEQ ID NO: 5705 - DNA, 13 bp, Artificial Sequence
  synthetic sequence
ctgtcgatcactc

SEQ ID NO: 5706 - DNA, 13 bp, Artificial Sequence
  synthetic sequence
gtgtgagcacaca

SEQ ID NO: 5707 - DNA, 13 bp, Artificial Sequence
  synthetic sequence
ctttcaccaagct

SEQ ID NO: 5708 - DNA, 13 bp, Artificial Sequence
  synthetic sequence
gcccctttctttt

SEQ ID NO: 5709 - DNA, 13 bp, Artificial Sequence
  synthetic sequence
tttctcctcaaaa

SEQ ID NO: 5710 - DNA, 13 bp, Artificial Sequence
  synthetic sequence
taagccatttgga

SEQ ID NO: 5711 - DNA, 13 bp, Artificial Sequence
  synthetic sequence
tgtcttcatatct

SEQ ID NO: 5712 - DNA, 13 bp, Artificial Sequence
  synthetic sequence
atgatttaacttc

SEQ ID NO: 5713 - DNA, 13 bp, Artificial Sequence
  synthetic sequence
catatgttgttcc

SEQ ID NO: 5714 - DNA, 13 bp, Artificial Sequence
  synthetic sequence
ccttggtctccgg

SEQ ID NO: 5715 - DNA, 13 bp, Artificial Sequence
  synthetic sequence
cctttggtgaggg

SEQ ID NO: 5716 - DNA, 13 bp, Artificial Sequence
  synthetic sequence
tccagggtcctcc

SEQ ID NO: 5717 - DNA, 13 bp, Artificial Sequence
  synthetic sequence
actcaacttccgg

SEQ ID NO: 5718 - DNA, 13 bp, Artificial Sequence
  synthetic sequence
atcagtccgtttg

SEQ ID NO: 5719 - DNA, 13 bp, Artificial Sequence
  synthetic sequence
cacattctgggac

SEQ ID NO: 5720 - DNA, 13 bp, Artificial Sequence
  synthetic sequence
gccgacagcactg

SEQ ID NO: 5721 - DNA, 13 bp, Artificial Sequence
  synthetic sequence
tggcaggtccacg

SEQ ID NO: 5722 - DNA, 13 bp, Artificial Sequence
  synthetic sequence
agcatccaaccaa

SEQ ID NO: 5723 - DNA, 13 bp, Artificial Sequence
  synthetic sequence
ccacttcatactt

SEQ ID NO: 5724 - DNA, 13 bp, Artificial Sequence
  synthetic sequence
aatctcatttcca

SEQ ID NO: 5725 - DNA, 13 bp, Artificial Sequence
  synthetic sequence
agccacataaacc

SEQ ID NO: 5726 - DNA, 13 bp, Artificial Sequence
  synthetic sequence
tcacatcataact

SEQ ID NO: 5727 - DNA, 13 bp, Artificial Sequence
  synthetic sequence
gctggttgtctgt

SEQ ID NO: 5728 - DNA, 13 bp, Artificial Sequence
  synthetic sequence
gttttgctgtgcc

SEQ ID NO: 5729 - DNA, 13 bp, Artificial Sequence
  synthetic sequence
agagccaagcata

SEQ ID NO: 5730 - DNA, 13 bp, Artificial Sequence
  synthetic sequence
ccccatcaagcaa

SEQ ID NO: 5731 - DNA, 13 bp, Artificial Sequence
  synthetic sequence
gcatgttaatgtt

SEQ ID NO: 5732 - DNA, 13 bp, Artificial Sequence
  synthetic sequence
gaactgccctttc

SEQ ID NO: 5733 - DNA, 13 bp, Artificial Sequence
  synthetic sequence
gcctccatattca

SEQ ID NO: 5734 - DNA, 13 bp, Artificial Sequence
  synthetic sequence
ttattgaggtcaa

SEQ ID NO: 5735 - DNA, 13 bp, Artificial Sequence
  synthetic sequence
tcttccggctgtc

SEQ ID NO: 5736 - DNA, 13 bp, Artificial Sequence
  synthetic sequence
accaccagtgttc

SEQ ID NO: 5737 - DNA, 13 bp, Artificial Sequence
  synthetic sequence
ctgactttgggtc

SEQ ID NO: 5738 - DNA, 13 bp, Artificial Sequence
  synthetic sequence
tgatgcccatcca

SEQ ID NO: 5739 - DNA, 13 bp, Artificial Sequence
  synthetic sequence
ctgggatctcagt

SEQ ID NO: 5740 - DNA, 13 bp, Artificial Sequence
  synthetic sequence
ttcatacctcctc

SEQ ID NO: 5741 - DNA, 13 bp, Artificial Sequence
  synthetic sequence
agagcatctggca

SEQ ID NO: 5742 - DNA, 13 bp, Artificial Sequence
  synthetic sequence
tttatgcatactt

SEQ ID NO: 5743 - DNA, 13 bp, Artificial Sequence
  synthetic sequence
tggttgatagcca

SEQ ID NO: 5744 - DNA, 13 bp, Artificial Sequence
  synthetic sequence
aggttgaggtcca

SEQ ID NO: 5745 - DNA, 13 bp, Artificial Sequence
  synthetic sequence
attcccatccaca

SEQ ID NO: 5746 - DNA, 13 bp, Artificial Sequence
  synthetic sequence
ccacattgcctga

SEQ ID NO: 5747 - DNA, 13 bp, Artificial Sequence
  synthetic sequence
gatgtggcagagt

SEQ ID NO: 5748 - DNA, 13 bp, Artificial Sequence
  synthetic sequence
actgatcgtagac

SEQ ID NO: 5749 - DNA, 13 bp, Artificial Sequence
  synthetic sequence
tctgcaaatcgag

SEQ ID NO: 5750 - DNA, 13 bp, Artificial Sequence
  synthetic sequence
agaaccggactcc

SEQ ID NO: 5751 - DNA, 13 bp, Artificial Sequence
  synthetic sequence
atgatgaacagga

SEQ ID NO: 5752 - DNA, 13 bp, Artificial Sequence
  synthetic sequence
ttggtgagcatga

SEQ ID NO: 5753 - DNA, 13 bp, Artificial Sequence
  synthetic sequence
ttcattgaggggg

SEQ ID NO: 5754 - DNA, 13 bp, Artificial Sequence
  synthetic sequence
acatctgaggacc

SEQ ID NO: 5755 - DNA, 13 bp, Artificial Sequence
  synthetic sequence
tgctcatcggctt

SEQ ID NO: 5756 - DNA, 13 bp, Artificial Sequence
  synthetic sequence
ggaatggacccat

SEQ ID NO: 5757 - DNA, 13 bp, Artificial Sequence
  synthetic sequence
atgacaatgacaa

SEQ ID NO: 5758 - DNA, 13 bp, Artificial Sequence
  synthetic sequence
gatggtggttgtg

SEQ ID NO: 5759 - DNA, 13 bp, Artificial Sequence
  synthetic sequence
cgcagcagtcaaa

SEQ ID NO: 5760 - DNA, 13 bp, Artificial Sequence
  synthetic sequence
aggaagatcatga

SEQ ID NO: 5761 - DNA, 13 bp, Artificial Sequence
  synthetic sequence
aagacccggcaag

SEQ ID NO: 5762 - DNA, 13 bp, Artificial Sequence
  synthetic sequence
aacatgatgggga

SEQ ID NO: 5763 - DNA, 13 bp, Artificial Sequence
  synthetic sequence
tctgaaatgaagg

SEQ ID NO: 5764 - DNA, 13 bp, Artificial Sequence
  synthetic sequence
gggaaggtggaca

SEQ ID NO: 5765 - DNA, 13 bp, Artificial Sequence
  synthetic sequence
gatagaggctggg

SEQ ID NO: 5766 - DNA, 13 bp, Artificial Sequence
  synthetic sequence
actctgaggaagg

SEQ ID NO: 5767 - DNA, 13 bp, Artificial Sequence
  synthetic sequence
aagcttgcccagg

SEQ ID NO: 5768 - DNA, 13 bp, Artificial Sequence
  synthetic sequence
gggagaatgtgcc

SEQ ID NO: 5769 - DNA, 13 bp, Artificial Sequence
  synthetic sequence
ttggctctgcctt

SEQ ID NO: 5770 - DNA, 13 bp, Artificial Sequence
  synthetic sequence
acaatcttgatga

SEQ ID NO: 5771 - DNA, 13 bp, Artificial Sequence
  synthetic sequence
aagagtgcccatg

SEQ ID NO: 5772 - DNA, 13 bp, Artificial Sequence
  synthetic sequence
gcagagatggtga

SEQ ID NO: 5773 - DNA, 13 bp, Artificial Sequence
  synthetic sequence
gagactctgatga

SEQ ID NO: 5774 - DNA, 13 bp, Artificial Sequence
  synthetic sequence
aagcagaagaaac

SEQ ID NO: 5775 - DNA, 13 bp, Artificial Sequence
  synthetic sequence
cattttccagaat

SEQ ID NO: 5776 - DNA, 13 bp, Artificial Sequence
  synthetic sequence
atcaggaaccctc

SEQ ID NO: 5777 - DNA, 13 bp, Artificial Sequence
  synthetic sequence
tgcagttggagga

SEQ ID NO: 5778 - DNA, 13 bp, Artificial Sequence
  synthetic sequence
gagaggtgattgg

SEQ ID NO: 5779 - DNA, 13 bp, Artificial Sequence
  synthetic sequence
atggtcgattcat

SEQ ID NO: 5780 - DNA, 13 bp, Artificial Sequence
  synthetic sequence
gctctctccaatg

SEQ ID NO: 5781 - DNA, 13 bp, Artificial Sequence
  synthetic sequence
tggtgttttgaag

SEQ ID NO: 5782 - DNA, 13 bp, Artificial Sequence
  synthetic sequence
aatgccaggtgca

SEQ ID NO: 5783 - DNA, 13 bp, Artificial Sequence
  synthetic sequence
tggacaggagaaa

SEQ ID NO: 5784 - DNA, 13 bp, Artificial Sequence
  synthetic sequence
atccatttgctct

SEQ ID NO: 5785 - DNA, 13 bp, Artificial Sequence
  synthetic sequence
ataatgcccacca

SEQ ID NO: 5786 - DNA, 13 bp, Artificial Sequence
  synthetic sequence
tgattccatcttg

SEQ ID NO: 5787 - DNA, 13 bp, Artificial Sequence
  synthetic sequence
gcaatcaataaag

SEQ ID NO: 5788 - DNA, 13 bp, Artificial Sequence
  synthetic sequence
taggggtccttca

SEQ ID NO: 5789 - DNA, 13 bp, Artificial Sequence
  synthetic sequence
accttcaaggaca

SEQ ID NO: 5790 - DNA, 13 bp, Artificial Sequence
  synthetic sequence
atgacaacaacct

SEQ ID NO: 5791 - DNA, 13 bp, Artificial Sequence
  synthetic sequence
ggcaatggaattc

SEQ ID NO: 5792 - DNA, 13 bp, Artificial Sequence
  synthetic sequence
agtggtgctttga

SEQ ID NO: 5793 - DNA, 13 bp, Artificial Sequence
  synthetic sequence
ggtctgttcatgg

SEQ ID NO: 5794 - DNA, 13 bp, Artificial Sequence
  synthetic sequence
ggactgtctatgt

SEQ ID NO: 5795 - DNA, 13 bp, Artificial Sequence
  synthetic sequence
acaagtgaagaca

SEQ ID NO: 5796 - DNA, 13 bp, Artificial Sequence
  synthetic sequence
cagtgaatggaaa

SEQ ID NO: 5797 - DNA, 13 bp, Artificial Sequence
  synthetic sequence
aacatgatgggaa

SEQ ID NO: 5798 - DNA, 13 bp, Artificial Sequence
  synthetic sequence
catcctgggcctc

SEQ ID NO: 5799 - DNA, 13 bp, Artificial Sequence
  synthetic sequence
gatgactggctga

SEQ ID NO: 5800 - DNA, 13 bp, Artificial Sequence
  synthetic sequence
caccgcatccgga

SEQ ID NO: 5801 - DNA, 13 bp, Artificial Sequence
  synthetic sequence
gaacatcatcact

SEQ ID NO: 5802 - DNA, 13 bp, Artificial Sequence
  synthetic sequence
actgtggttatca

SEQ ID NO: 5803 - DNA, 13 bp, Artificial Sequence
  synthetic sequence
accgcagtggact

SEQ ID NO: 5804 - DNA, 13 bp, Artificial Sequence
  synthetic sequence
tcaatccaatagc

SEQ ID NO: 5805 - DNA, 13 bp, Artificial Sequence
  synthetic sequence
tcttgctggctgg

SEQ ID NO: 5806 - DNA, 13 bp, Artificial Sequence
  synthetic sequence
ggaatcctgatga

SEQ ID NO: 5807 - DNA, 13 bp, Artificial Sequence
  synthetic sequence
ctggtgcaatgcg

SEQ ID NO: 5808 - DNA, 13 bp, Artificial Sequence
  synthetic sequence
cctttctgctctc

SEQ ID NO: 5809 - DNA, 13 bp, Artificial Sequence
  synthetic sequence
acccttacaggac

SEQ ID NO: 5810 - DNA, 13 bp, Artificial Sequence
  synthetic sequence
aggaaaatcatga

SEQ ID NO: 5811 - DNA, 13 bp, Artificial Sequence
  synthetic sequence
tacccacacatga

SEQ ID NO: 5812 - DNA, 13 bp, Artificial Sequence
  synthetic sequence
atcaggaatcctc

SEQ ID NO: 5813 - DNA, 13 bp, Artificial Sequence
  synthetic sequence
tgtggcctgtttg

SEQ ID NO: 5814 - DNA, 13 bp, Artificial Sequence
  synthetic sequence
tgaaagtgcaaca

SEQ ID NO: 5815 - DNA, 13 bp, Artificial Sequence
  synthetic sequence
catggatgcaagt

SEQ ID NO: 5816 - DNA, 13 bp, Artificial Sequence
  synthetic sequence
gtcaggtccagac

SEQ ID NO: 5817 - DNA, 13 bp, Artificial Sequence
  synthetic sequence
atggctgaagctg

SEQ ID NO: 5818 - DNA, 13 bp, Artificial Sequence
  synthetic sequence
atggcagaagcag

SEQ ID NO: 5819 - DNA, 13 bp, Artificial Sequence
  synthetic sequence
tggtcactgtcaa

SEQ ID NO: 5820 - DNA, 13 bp, Artificial Sequence
  synthetic sequence
ccaccgcctggaa

SEQ ID NO: 5821 - DNA, 13 bp, Artificial Sequence
  synthetic sequence
tccatgggggcac

SEQ ID NO: 5822 - DNA, 13 bp, Artificial Sequence
  synthetic sequence
cagatggttgctc

SEQ ID NO: 5823 - DNA, 13 bp, Artificial Sequence
  synthetic sequence
aatgacaacaact

SEQ ID NO: 5824 - DNA, 13 bp, Artificial Sequence
  synthetic sequence
cagtatggatgga

SEQ ID NO: 5825 - DNA, 13 bp, Artificial Sequence
  synthetic sequence
tttgtcctcatgg

SEQ ID NO: 5826 - DNA, 13 bp, Artificial Sequence
  synthetic sequence
atacatccatttg

SEQ ID NO: 5827 - DNA, 13 bp, Artificial Sequence
  synthetic sequence
cttggatgcaggt

SEQ ID NO: 5828 - DNA, 13 bp, Artificial Sequence
  synthetic sequence
aagtggacaccgg

SEQ ID NO: 5829 - DNA, 13 bp, Artificial Sequence
  synthetic sequence
ctggtgagcatga

SEQ ID NO: 5830 - DNA, 13 bp, Artificial Sequence
  synthetic sequence
atcagtgtgttcc

SEQ ID NO: 5831 - DNA, 13 bp, Artificial Sequence
  synthetic sequence
cccagaaacccgc

SEQ ID NO: 5832 - DNA, 13 bp, Artificial Sequence
  synthetic sequence
tcaggaatcccct

SEQ ID NO: 5833 - DNA, 13 bp, Artificial Sequence
  synthetic sequence
cagcaatcaaagc

SEQ ID NO: 5834 - DNA, 13 bp, Artificial Sequence
  synthetic sequence
gtgggaaaaggaa

SEQ ID NO: 5835 - DNA, 13 bp, Artificial Sequence
  synthetic sequence
actactcagaacc

SEQ ID NO: 5836 - DNA, 13 bp, Artificial Sequence
  synthetic sequence
gaaaggtggacac

SEQ ID NO: 5837 - DNA, 13 bp, Artificial Sequence
  synthetic sequence
tgtcagagatgaa

SEQ ID NO: 5838 - DNA, 13 bp, Artificial Sequence
  synthetic sequence
tgctgttctgcac

SEQ ID NO: 5839 - DNA, 13 bp, Artificial Sequence
  synthetic sequence
gatgacgagcaag

SEQ ID NO: 5840 - DNA, 13 bp, Artificial Sequence
  synthetic sequence
gaggaatggaaag

SEQ ID NO: 5841 - DNA, 13 bp, Artificial Sequence
  synthetic sequence
tgttttgagggtc

SEQ ID NO: 5842 - DNA, 13 bp, Artificial Sequence
  synthetic sequence
caatggctgtggt

SEQ ID NO: 5843 - DNA, 13 bp, Artificial Sequence
  synthetic sequence
gacgatgttgtct

SEQ ID NO: 5844 - DNA, 13 bp, Artificial Sequence
  synthetic sequence
aagttcacagact

SEQ ID NO: 5845 - DNA, 13 bp, Artificial Sequence
  synthetic sequence
ggaatattgtgac

SEQ ID NO: 5846 - DNA, 13 bp, Artificial Sequence
  synthetic sequence
acactagtctgtt

SEQ ID NO: 5847 - DNA, 13 bp, Artificial Sequence
  synthetic sequence
gcctgctcatggg

SEQ ID NO: 5848 - DNA, 13 bp, Artificial Sequence
  synthetic sequence
gagcaaatgagag

SEQ ID NO: 5849 - DNA, 13 bp, Artificial Sequence
  synthetic sequence
actagggttgttc

SEQ ID NO: 5850 - DNA, 13 bp, Artificial Sequence
  synthetic sequence
ttcttgcactctg

SEQ ID NO: 5851 - DNA, 13 bp, Artificial Sequence
  synthetic sequence
gggggatcctcat

SEQ ID NO: 5852 - DNA, 13 bp, Artificial Sequence
  synthetic sequence
cgtggtctgtcca

SEQ ID NO: 5853 - DNA, 13 bp, Artificial Sequence
  synthetic sequence
tttggttctgcct

SEQ ID NO: 5854 - DNA, 13 bp, Artificial Sequence
  synthetic sequence
gggaaaggaattc

SEQ ID NO: 5855 - DNA, 13 bp, Artificial Sequence
  synthetic sequence
tagagggaaacac

SEQ ID NO: 5856 - DNA, 13 bp, Artificial Sequence
  synthetic sequence
ggtgcaatgaggg

SEQ ID NO: 5857 - DNA, 13 bp, Artificial Sequence
  synthetic sequence
atggtctgcagta

SEQ ID NO: 5858 - DNA, 13 bp, Artificial Sequence
  synthetic sequence
ggacacatccgtt

SEQ ID NO: 5859 - DNA, 13 bp, Artificial Sequence
  synthetic sequence
tgggaagaagagc

SEQ ID NO: 5860 - DNA, 13 bp, Artificial Sequence
  synthetic sequence
gtgaagtggtggg

SEQ ID NO: 5861 - DNA, 13 bp, Artificial Sequence
  synthetic sequence
cttcttgttcaac

SEQ ID NO: 5862 - DNA, 13 bp, Artificial Sequence
  synthetic sequence
aatggcaagaagc

SEQ ID NO: 5863 - DNA, 13 bp, Artificial Sequence
  synthetic sequence
gaaatgaaggaag

SEQ ID NO: 5864 - DNA, 13 bp, Artificial Sequence
  synthetic sequence
aatcggccaagaa

SEQ ID NO: 5865 - DNA, 13 bp, Artificial Sequence
  synthetic sequence
cagctgaggactt

SEQ ID NO: 5866 - DNA, 13 bp, Artificial Sequence
  synthetic sequence
atttccatgaact

SEQ ID NO: 5867 - DNA, 13 bp, Artificial Sequence
  synthetic sequence
ttggactgcgcac

SEQ ID NO: 5868 - DNA, 13 bp, Artificial Sequence
  synthetic sequence
cggactgaaaact

SEQ ID NO: 5869 - DNA, 13 bp, Artificial Sequence
  synthetic sequence
cattctgaggagg

SEQ ID NO: 5870 - DNA, 13 bp, Artificial Sequence
  synthetic sequence
tcttcctggaatc

SEQ ID NO: 5871 - DNA, 13 bp, Artificial Sequence
  synthetic sequence
gagactcagatga

SEQ ID NO: 5872 - DNA, 13 bp, Artificial Sequence
  synthetic sequence
ccctttccagaaa

SEQ ID NO: 5873 - DNA, 13 bp, Artificial Sequence
  synthetic sequence
gacatggaaaatt

SEQ ID NO: 5874 - DNA, 13 bp, Artificial Sequence
  synthetic sequence
tcctacatcatgc

SEQ ID NO: 5875 - DNA, 13 bp, Artificial Sequence
  synthetic sequence
ttgcaacgatgct

SEQ ID NO: 5876 - DNA, 13 bp, Artificial Sequence
  synthetic sequence
gagggtctcctct

SEQ ID NO: 5877 - DNA, 13 bp, Artificial Sequence
  synthetic sequence
caaaggtctgctt

SEQ ID NO: 5878 - DNA, 13 bp, Artificial Sequence
  synthetic sequence
ttttatcccggtt

SEQ ID NO: 5879 - DNA, 13 bp, Artificial Sequence
  synthetic sequence
gctgccattcaga

SEQ ID NO: 5880 - DNA, 13 bp, Artificial Sequence
  synthetic sequence
tgtattcaaagac

SEQ ID NO: 5881 - DNA, 13 bp, Artificial Sequence
  synthetic sequence
ctggtggatcctt

SEQ ID NO: 5882 - DNA, 13 bp, Artificial Sequence
  synthetic sequence
ccaccacactctt

SEQ ID NO: 5883 - DNA, 13 bp, Artificial Sequence
  synthetic sequence
acatctggcatgt

SEQ ID NO: 5884 - DNA, 13 bp, Artificial Sequence
  synthetic sequence
ctttgcacattca

SEQ ID NO: 5885 - DNA, 13 bp, Artificial Sequence
  synthetic sequence
caatgcgccccct

SEQ ID NO: 5886 - DNA, 13 bp, Artificial Sequence
  synthetic sequence
acaatgccttcag

SEQ ID NO: 5887 - DNA, 13 bp, Artificial Sequence
  synthetic sequence
gtgacatgccaca

SEQ ID NO: 5888 - DNA, 13 bp, Artificial Sequence
  synthetic sequence
ctcttgccaaagt

SEQ ID NO: 5889 - DNA, 13 bp, Artificial Sequence
  synthetic sequence
tcatcacaacctg

SEQ ID NO: 5890 - DNA, 13 bp, Artificial Sequence
  synthetic sequence
tacacacaagtcc

SEQ ID NO: 5891 - DNA, 13 bp, Artificial Sequence
  synthetic sequence
gcatcaaacttga

SEQ ID NO: 5892 - DNA, 13 bp, Artificial Sequence
  synthetic sequence
gtcaacagagcca

SEQ ID NO: 5893 - DNA, 13 bp, Artificial Sequence
  synthetic sequence
agaatccaccacc

SEQ ID NO: 5894 - DNA, 13 bp, Artificial Sequence
  synthetic sequence
gttcactcagcac

SEQ ID NO: 5895 - DNA, 13 bp, Artificial Sequence
  synthetic sequence
cagccttggccac

SEQ ID NO: 5896 - DNA, 13 bp, Artificial Sequence
  synthetic sequence
cccatgacggcca

SEQ ID NO: 5897 - DNA, 13 bp, Artificial Sequence
  synthetic sequence
ggcatcactgtta

SEQ ID NO: 5898 - DNA, 13 bp, Artificial Sequence
  synthetic sequence
ttcaaggagcctt

SEQ ID NO: 5899 - DNA, 13 bp, Artificial Sequence
  synthetic sequence
ggtcattccaatc

SEQ ID NO: 5900 - DNA, 13 bp, Artificial Sequence
  synthetic sequence
gtttgacgcctcc

SEQ ID NO: 5901 - DNA, 13 bp, Artificial Sequence
  synthetic sequence
aaggtcactccac

SEQ ID NO: 5902 - DNA, 13 bp, Artificial Sequence
  synthetic sequence
cctgccagcactc

SEQ ID NO: 5903 - DNA, 13 bp, Artificial Sequence
  synthetic sequence
gccatatacatgg

SEQ ID NO: 5904 - DNA, 13 bp, Artificial Sequence
  synthetic sequence
gcctgctgagtca

SEQ ID NO: 5905 - DNA, 13 bp, Artificial Sequence
  synthetic sequence
tccacctccacaa

SEQ ID NO: 5906 - DNA, 13 bp, Artificial Sequence
  synthetic sequence
atccggccaactc

SEQ ID NO: 5907 - DNA, 13 bp, Artificial Sequence
  synthetic sequence
agcctcatgtccc

SEQ ID NO: 5908 - DNA, 13 bp, Artificial Sequence
  synthetic sequence
gtgatggtgttca

SEQ ID NO: 5909 - DNA, 13 bp, Artificial Sequence
  synthetic sequence
agtgagctgagta

SEQ ID NO: 5910 - DNA, 13 bp, Artificial Sequence
  synthetic sequence
tcagctactatca

SEQ ID NO: 5911 - DNA, 13 bp, Artificial Sequence
  synthetic sequence
tctggtaaacatt

SEQ ID NO: 5912 - DNA, 13 bp, Artificial Sequence
  synthetic sequence
gccaagatctgtg

SEQ ID NO: 5913 - DNA, 13 bp, Artificial Sequence
  synthetic sequence
attttatcctctc

SEQ ID NO: 5914 - DNA, 13 bp, Artificial Sequence
  synthetic sequence
gttttccttggcc

SEQ ID NO: 5915 - DNA, 13 bp, Artificial Sequence
  synthetic sequence
tgcgctgcccaac

SEQ ID NO: 5916 - DNA, 13 bp, Artificial Sequence
  synthetic sequence
cacgcattgtccc

SEQ ID NO: 5917 - DNA, 13 bp, Artificial Sequence
  synthetic sequence
aagagcgacagcc

SEQ ID NO: 5918 - DNA, 13 bp, Artificial Sequence
  synthetic sequence
ggatatgattgtg

SEQ ID NO: 5919 - DNA, 13 bp, Artificial Sequence
  synthetic sequence
atgtgagatgccc

SEQ ID NO: 5920 - DNA, 13 bp, Artificial Sequence
  synthetic sequence
accctctcttcaa

SEQ ID NO: 5921 - DNA, 13 bp, Artificial Sequence
  synthetic sequence
ctgctatgctagc

SEQ ID NO: 5922 - DNA, 13 bp, Artificial Sequence
  synthetic sequence
gagatgtctacct

SEQ ID NO: 5923 - DNA, 13 bp, Artificial Sequence
  synthetic sequence
gccaatgacagca

SEQ ID NO: 5924 - DNA, 13 bp, Artificial Sequence
  synthetic sequence
aatcacacttgcc

SEQ ID NO: 5925 - DNA, 13 bp, Artificial Sequence
  synthetic sequence
ctcgggtagtcaa

SEQ ID NO: 5926 - DNA, 13 bp, Artificial Sequence
  synthetic sequence
aggctgggccaac

SEQ ID NO: 5927 - DNA, 13 bp, Artificial Sequence
  synthetic sequence
ccacgagaccagc

SEQ ID NO: 5928 - DNA, 13 bp, Artificial Sequence
  synthetic sequence
ggtctgatctcca

SEQ ID NO: 5929 - DNA, 13 bp, Artificial Sequence
  synthetic sequence
aacatgagatatc

SEQ ID NO: 5930 - DNA, 13 bp, Artificial Sequence
  synthetic sequence
acagctcaaactg

SEQ ID NO: 5931 - DNA, 13 bp, Artificial Sequence
  synthetic sequence
acaagtgtgcgca

SEQ ID NO: 5932 - DNA, 13 bp, Artificial Sequence
  synthetic sequence
ttgtctggacctt

SEQ ID NO: 5933 - DNA, 13 bp, Artificial Sequence
  synthetic sequence
tccttcattttct

SEQ ID NO: 5934 - DNA, 13 bp, Artificial Sequence
  synthetic sequence
gccacttgccatg

SEQ ID NO: 5935 - DNA, 13 bp, Artificial Sequence
  synthetic sequence
gacgtgccacatc

SEQ ID NO: 5936 - DNA, 13 bp, Artificial Sequence
  synthetic sequence
gctgtgagatcat

SEQ ID NO: 5937 - DNA, 13 bp, Artificial Sequence
  synthetic sequence
tctggccagctcc

SEQ ID NO: 5938 - DNA, 13 bp, Artificial Sequence
  synthetic sequence
cacatccttggtc

SEQ ID NO: 5939 - DNA, 13 bp, Artificial Sequence
  synthetic sequence
atcagcagcattc

SEQ ID NO: 5940 - DNA, 13 bp, Artificial Sequence
  synthetic sequence
tcttcaaggatcc

SEQ ID NO: 5941 - DNA, 13 bp, Artificial Sequence
  synthetic sequence
tgaagcatggcgc

SEQ ID NO: 5942 - DNA, 13 bp, Artificial Sequence
  synthetic sequence
ctcctccgttatt

SEQ ID NO: 5943 - DNA, 13 bp, Artificial Sequence
  synthetic sequence
gtcaccacctgcc

SEQ ID NO: 5944 - DNA, 13 bp, Artificial Sequence
  synthetic sequence
caatgcgtcctct

SEQ ID NO: 5945 - DNA, 13 bp, Artificial Sequence
  synthetic sequence
ccatcattttcct

SEQ ID NO: 5946 - DNA, 13 bp, Artificial Sequence
  synthetic sequence
catcacagtccac

SEQ ID NO: 5947 - DNA, 13 bp, Artificial Sequence
  synthetic sequence
ttctctatcacat

SEQ ID NO: 5948 - DNA, 13 bp, Artificial Sequence
  synthetic sequence
ggtttcagatcca

SEQ ID NO: 5949 - DNA, 13 bp, Artificial Sequence
  synthetic sequence
gccacaatcacgg

SEQ ID NO: 5950 - DNA, 13 bp, Artificial Sequence
  synthetic sequence
ctggtcccagggc

SEQ ID NO: 5951 - DNA, 13 bp, Artificial Sequence
  synthetic sequence
catcactgcaaga

SEQ ID NO: 5952 - DNA, 13 bp, Artificial Sequence
  synthetic sequence
agtgccatcaggg

SEQ ID NO: 5953 - DNA, 13 bp, Artificial Sequence
  synthetic sequence
tctaccaccacgt

SEQ ID NO: 5954 - DNA, 13 bp, Artificial Sequence
  synthetic sequence
gccattctgaaat

SEQ ID NO: 5955 - DNA, 13 bp, Artificial Sequence
  synthetic sequence
ctaaggaaaaagg

SEQ ID NO: 5956 - DNA, 13 bp, Artificial Sequence
  synthetic sequence
ggcatcgcccctg

SEQ ID NO: 5957 - DNA, 13 bp, Artificial Sequence
  synthetic sequence
gcaggagggtctt

SEQ ID NO: 5958 - DNA, 13 bp, Artificial Sequence
  synthetic sequence
catgtacatggca

SEQ ID NO: 5959 - DNA, 13 bp, Artificial Sequence
  synthetic sequence
gtttctcatggcc

SEQ ID NO: 5960 - DNA, 13 bp, Artificial Sequence
  synthetic sequence
tgaattcagcctc

SEQ ID NO: 5961 - DNA, 13 bp, Artificial Sequence
  synthetic sequence
tgatgtctgttct

SEQ ID NO: 5962 - DNA, 13 bp, Artificial Sequence
  synthetic sequence
gtgtcatccgcat

SEQ ID NO: 5963 - DNA, 13 bp, Artificial Sequence
  synthetic sequence
gggagctcactca

SEQ ID NO: 5964 - DNA, 13 bp, Artificial Sequence
  synthetic sequence
ccaccacattttt

SEQ ID NO: 5965 - DNA, 13 bp, Artificial Sequence
  synthetic sequence
cttccataggcca

SEQ ID NO: 5966 - DNA, 13 bp, Artificial Sequence
  synthetic sequence
tggtgatggtatt

SEQ ID NO: 5967 - DNA, 13 bp, Artificial Sequence
  synthetic sequence
tatgcaatgggca

SEQ ID NO: 5968 - DNA, 13 bp, Artificial Sequence
  synthetic sequence
ttctggcacactc

SEQ ID NO: 5969 - DNA, 13 bp, Artificial Sequence
  synthetic sequence
cccaccaagccag

SEQ ID NO: 5970 - DNA, 13 bp, Artificial Sequence
  synthetic sequence
ccaccaatgccgc

SEQ ID NO: 5971 - DNA, 13 bp, Artificial Sequence
  synthetic sequence
acttttagattgg

SEQ ID NO: 5972 - DNA, 13 bp, Artificial Sequence
  synthetic sequence
actcctcctgata

SEQ ID NO: 5973 - DNA, 13 bp, Artificial Sequence
  synthetic sequence
tccttatccaatg

SEQ ID NO: 5974 - DNA, 13 bp, Artificial Sequence
  synthetic sequence
aggttccactggg

SEQ ID NO: 5975 - DNA, 13 bp, Artificial Sequence
  synthetic sequence
gctaaaatcccag

SEQ ID NO: 5976 - DNA, 13 bp, Artificial Sequence
  synthetic sequence
aactccgtgagga

SEQ ID NO: 5977 - DNA, 13 bp, Artificial Sequence
  synthetic sequence
ccctcttgtgaaa

SEQ ID NO: 5978 - DNA, 13 bp, Artificial Sequence
  synthetic sequence
gtacacacaggtc

SEQ ID NO: 5979 - DNA, 13 bp, Artificial Sequence
  synthetic sequence
gcaccttgtaacc

SEQ ID NO: 5980 - DNA, 13 bp, Artificial Sequence
  synthetic sequence
acaataggagatc

SEQ ID NO: 5981 - DNA, 13 bp, Artificial Sequence
  synthetic sequence
gtctaatctccat

SEQ ID NO: 5982 - DNA, 13 bp, Artificial Sequence
  synthetic sequence
gccatcaagggca

SEQ ID NO: 5983 - DNA, 13 bp, Artificial Sequence
  synthetic sequence
gctgcccagcctc

SEQ ID NO: 5984 - DNA, 13 bp, Artificial Sequence
  synthetic sequence
accatccattgca

SEQ ID NO: 5985 - DNA, 13 bp, Artificial Sequence
  synthetic sequence
gtctcctccattg

SEQ ID NO: 5986 - DNA, 13 bp, Artificial Sequence
  synthetic sequence
cgcattatccccc

SEQ ID NO: 5987 - DNA, 13 bp, Artificial Sequence
  synthetic sequence
aacatgaggtatc

SEQ ID NO: 5988 - DNA, 13 bp, Artificial Sequence
  synthetic sequence
gtagatgttcttt

SEQ ID NO: 5989 - DNA, 13 bp, Artificial Sequence
  synthetic sequence
tgacagggcatca

SEQ ID NO: 5990 - DNA, 13 bp, Artificial Sequence
  synthetic sequence
tccgaccaaagcc

SEQ ID NO: 5991 - DNA, 13 bp, Artificial Sequence
  synthetic sequence
caggaatatgatt

SEQ ID NO: 5992 - DNA, 13 bp, Artificial Sequence
  synthetic sequence
tgggaagtctcag

SEQ ID NO: 5993 - DNA, 13 bp, Artificial Sequence
  synthetic sequence
cccagggccaaca

SEQ ID NO: 5994 - DNA, 13 bp, Artificial Sequence
  synthetic sequence
ggagtccggttct

SEQ ID NO: 5995 - DNA, 13 bp, Artificial Sequence
  synthetic sequence
caatgggtgaacc

SEQ ID NO: 5996 - DNA, 13 bp, Artificial Sequence
  synthetic sequence
ccagcagagctga

SEQ ID NO: 5997 - DNA, 13 bp, Artificial Sequence
  synthetic sequence
ccgtgagaaccac

SEQ ID NO: 5998 - DNA, 13 bp, Artificial Sequence
  synthetic sequence
aaacaggcaggtc

SEQ ID NO: 5999 - DNA, 13 bp, Artificial Sequence
  synthetic sequence
atcaccatgctca

SEQ ID NO: 6000 - DNA, 13 bp, Artificial Sequence
  synthetic sequence
aatcctccccctt

SEQ ID NO: 6001 - DNA, 13 bp, Artificial Sequence
  synthetic sequence
atgtggccctgtt

SEQ ID NO: 6002 - DNA, 13 bp, Artificial Sequence
  synthetic sequence
gggggatcactgt

SEQ ID NO: 6003 - DNA, 13 bp, Artificial Sequence
  synthetic sequence
atgccttcggcta

SEQ ID NO: 6004 - DNA, 13 bp, Artificial Sequence
  synthetic sequence
gtctaatttccat

SEQ ID NO: 6005 - DNA, 13 bp, Artificial Sequence
  synthetic sequence
tcatgggcttttc

SEQ ID NO: 6006 - DNA, 13 bp, Artificial Sequence
  synthetic sequence
accagatggcttt

SEQ ID NO: 6007 - DNA, 13 bp, Artificial Sequence
  synthetic sequence
acctgccaggata

SEQ ID NO: 6008 - DNA, 13 bp, Artificial Sequence
  synthetic sequence
tacagctcaaatt

SEQ ID NO: 6009 - DNA, 13 bp, Artificial Sequence
  synthetic sequence
gtcagttatccca

SEQ ID NO: 6010 - DNA, 17 bp, Artificial Sequence
  synthetic sequence
ggtctgcaaatcgagtt

SEQ ID NO: 6011 - DNA, 17 bp, Artificial Sequence
  synthetic sequence
gagaaccggactccaca

SEQ ID NO: 6012 - DNA, 17 bp, Artificial Sequence
  synthetic sequence
ggatttcattgaggggg

SEQ ID NO: 6013 - DNA, 17 bp, Artificial Sequence
  synthetic sequence
aaagcgcagcagtcaaa

SEQ ID NO: 6014 - DNA, 17 bp, Artificial Sequence
  synthetic sequence
tatgacaatgacaaccc

SEQ ID NO: 6015 - DNA, 17 bp, Artificial Sequence
  synthetic sequence
gcaacaatcttgatgac

SEQ ID NO: 6016 - DNA, 17 bp, Artificial Sequence
  synthetic sequence
gtgtttggctctgcctt

SEQ ID NO: 6017 - DNA, 17 bp, Artificial Sequence
  synthetic sequence
gaagggaaggtggacac

SEQ ID NO: 6018 - DNA, 17 bp, Artificial Sequence
  synthetic sequence
ctgctcatcggctttgg

SEQ ID NO: 6019 - DNA, 17 bp, Artificial Sequence
  synthetic sequence
gagggaaacaccagcct

SEQ ID NO: 6020 - DNA, 17 bp, Artificial Sequence
  synthetic sequence
gcagagatggtgataca

SEQ ID NO: 6021 - DNA, 17 bp, Artificial Sequence
  synthetic sequence
tttagagactctgatga

SEQ ID NO: 6022 - DNA, 17 bp, Artificial Sequence
  synthetic sequence
tgggagaatgtgccctt

SEQ ID NO: 6023 - DNA, 17 bp, Artificial Sequence
  synthetic sequence
tctgatagaggctgggg

SEQ ID NO: 6024 - DNA, 17 bp, Artificial Sequence
  synthetic sequence
cagaagaaacctgactt

SEQ ID NO: 6025 - DNA, 17 bp, Artificial Sequence
  synthetic sequence
catggtcgattcatggg

SEQ ID NO: 6026 - DNA, 17 bp, Artificial Sequence
  synthetic sequence
atgctcatattctttgt

SEQ ID NO: 6027 - DNA, 17 bp, Artificial Sequence
  synthetic sequence
accttgatgatgaacag

SEQ ID NO: 6028 - DNA, 17 bp, Artificial Sequence
  synthetic sequence
tggagaacttccttggt

SEQ ID NO: 6029 - DNA, 17 bp, Artificial Sequence
  synthetic sequence
gtgatcaggaaccctct

SEQ ID NO: 6030 - DNA, 17 bp, Artificial Sequence
  synthetic sequence
catccattttccagaat

SEQ ID NO: 6031 - DNA, 17 bp, Artificial Sequence
  synthetic sequence
aacagatggttgctcct

SEQ ID NO: 6032 - DNA, 17 bp, Artificial Sequence
  synthetic sequence
atcatgaaagttgtcaa

SEQ ID NO: 6033 - DNA, 17 bp, Artificial Sequence
  synthetic sequence
tggatgcaggtaccact

SEQ ID NO: 6034 - DNA, 17 bp, Artificial Sequence
  synthetic sequence
tcagagtttgggaaagc

SEQ ID NO: 6035 - DNA, 17 bp, Artificial Sequence
  synthetic sequence
gctggagaaatacatgc

SEQ ID NO: 6036 - DNA, 17 bp, Artificial Sequence
  synthetic sequence
tgccaggtgcaaactgc

SEQ ID NO: 6037 - DNA, 17 bp, Artificial Sequence
  synthetic sequence
aaaaagagtgcccatgg

SEQ ID NO: 6038 - DNA, 17 bp, Artificial Sequence
  synthetic sequence
ttgaagacccggcaaga

SEQ ID NO: 6039 - DNA, 17 bp, Artificial Sequence
  synthetic sequence
acaatgctctctccaat

SEQ ID NO: 6040 - DNA, 17 bp, Artificial Sequence
  synthetic sequence
gtccttgctgggtggct

SEQ ID NO: 6041 - DNA, 17 bp, Artificial Sequence
  synthetic sequence
aacggagaggtgattgg

SEQ ID NO: 6042 - DNA, 17 bp, Artificial Sequence
  synthetic sequence
ggtgttttgaaggccct

SEQ ID NO: 6043 - DNA, 17 bp, Artificial Sequence
  synthetic sequence
tccactctgaggaaggc

SEQ ID NO: 6044 - DNA, 17 bp, Artificial Sequence
  synthetic sequence
aatggcaagaagttgat

SEQ ID NO: 6045 - DNA, 17 bp, Artificial Sequence
  synthetic sequence
atccatcgtatccgaac

SEQ ID NO: 6046 - DNA, 17 bp, Artificial Sequence
  synthetic sequence
ctgagcctacaagtgaa

SEQ ID NO: 6047 - DNA, 17 bp, Artificial Sequence
  synthetic sequence
gacaacaacctttacaa

SEQ ID NO: 6048 - DNA, 17 bp, Artificial Sequence
  synthetic sequence
ggttgttctttctgaaa

SEQ ID NO: 6049 - DNA, 17 bp, Artificial Sequence
  synthetic sequence
ttatcataggggtcctt

SEQ ID NO: 6050 - DNA, 17 bp, Artificial Sequence
  synthetic sequence
aaggcattttggttaca

SEQ ID NO: 6051 - DNA, 17 bp, Artificial Sequence
  synthetic sequence
cttcaaggacaaaactg

SEQ ID NO: 6052 - DNA, 17 bp, Artificial Sequence
  synthetic sequence
aaggatttatctttttc

SEQ ID NO: 6053 - DNA, 17 bp, Artificial Sequence
  synthetic sequence
tatggcaatggaattct

SEQ ID NO: 6054 - DNA, 17 bp, Artificial Sequence
  synthetic sequence
ctctctgaaatgaagga

SEQ ID NO: 6055 - DNA, 17 bp, Artificial Sequence
  synthetic sequence
gtgaatggaaagaagag

SEQ ID NO: 6056 - DNA, 17 bp, Artificial Sequence
  synthetic sequence
gcttggactgtctatgt

SEQ ID NO: 6057 - DNA, 17 bp, Artificial Sequence
  synthetic sequence
catctgaggaccttggg

SEQ ID NO: 6058 - DNA, 17 bp, Artificial Sequence
  synthetic sequence
gagcccacaagtgaaga

SEQ ID NO: 6059 - DNA, 17 bp, Artificial Sequence
  synthetic sequence
tggatgcaggtgccact

SEQ ID NO: 6060 - DNA, 17 bp, Artificial Sequence
  synthetic sequence
ggatgggacacacgcat

SEQ ID NO: 6061 - DNA, 17 bp, Artificial Sequence
  synthetic sequence
gaccgaaagtggtgctt

SEQ ID NO: 6062 - DNA, 17 bp, Artificial Sequence
  synthetic sequence
cgtggtctgttcatggg

SEQ ID NO: 6063 - DNA, 17 bp, Artificial Sequence
  synthetic sequence
aatccaatagcctccac

SEQ ID NO: 6064 - DNA, 17 bp, Artificial Sequence
  synthetic sequence
aaggttgtcaataggtg

SEQ ID NO: 6065 - DNA, 17 bp, Artificial Sequence
  synthetic sequence
ttgagaaagaatacccc

SEQ ID NO: 6066 - DNA, 17 bp, Artificial Sequence
  synthetic sequence
tggttcttgctggctgg

SEQ ID NO: 6067 - DNA, 17 bp, Artificial Sequence
  synthetic sequence
cagaccgcagtggactt

SEQ ID NO: 6068 - DNA, 17 bp, Artificial Sequence
  synthetic sequence
tggaacatcatcacttt

SEQ ID NO: 6069 - DNA, 17 bp, Artificial Sequence
  synthetic sequence
tgcactgtggttatcat

SEQ ID NO: 6070 - DNA, 17 bp, Artificial Sequence
  synthetic sequence
cctgggcctcagtcaag

SEQ ID NO: 6071 - DNA, 17 bp, Artificial Sequence
  synthetic sequence
atacaccgcatccggac

SEQ ID NO: 6072 - DNA, 17 bp, Artificial Sequence
  synthetic sequence
agagattcagatgactg

SEQ ID NO: 6073 - DNA, 17 bp, Artificial Sequence
  synthetic sequence
tggggaagagagaaaag

SEQ ID NO: 6074 - DNA, 17 bp, Artificial Sequence
  synthetic sequence
ggtccagtcgcagttgg

SEQ ID NO: 6075 - DNA, 17 bp, Artificial Sequence
  synthetic sequence
cctttctgctctcacca

SEQ ID NO: 6076 - DNA, 17 bp, Artificial Sequence
  synthetic sequence
ttgatggtggttgtggt

SEQ ID NO: 6077 - DNA, 17 bp, Artificial Sequence
  synthetic sequence
cccacacatgaaaatca

SEQ ID NO: 6078 - DNA, 17 bp, Artificial Sequence
  synthetic sequence
gtgacggctggagagat

SEQ ID NO: 6079 - DNA, 17 bp, Artificial Sequence
  synthetic sequence
gacacaaataacagcaa

SEQ ID NO: 6080 - DNA, 17 bp, Artificial Sequence
  synthetic sequence
gaatacaccgccacttg

SEQ ID NO: 6081 - DNA, 17 bp, Artificial Sequence
  synthetic sequence
aggatttattttcttct

SEQ ID NO: 6082 - DNA, 17 bp, Artificial Sequence
  synthetic sequence
aatgaaagtgcaacaat

SEQ ID NO: 6083 - DNA, 17 bp, Artificial Sequence
  synthetic sequence
ccatggatgcaagtccc

SEQ ID NO: 6084 - DNA, 17 bp, Artificial Sequence
  synthetic sequence
tgtcaggtccagactgc

SEQ ID NO: 6085 - DNA, 17 bp, Artificial Sequence
  synthetic sequence
aatggttgtggcctgtt

SEQ ID NO: 6086 - DNA, 17 bp, Artificial Sequence
  synthetic sequence
tggacactatcagcgtg

SEQ ID NO: 6087 - DNA, 17 bp, Artificial Sequence
  synthetic sequence
aattctacccacgagat

SEQ ID NO: 6088 - DNA, 17 bp, Artificial Sequence
  synthetic sequence
gtgatacatcaccaaca

SEQ ID NO: 6089 - DNA, 17 bp, Artificial Sequence
  synthetic sequence
ttgtcctcatggtcgtc

SEQ ID NO: 6090 - DNA, 17 bp, Artificial Sequence
  synthetic sequence
aatgacaacaacttgta

SEQ ID NO: 6091 - DNA, 17 bp, Artificial Sequence
  synthetic sequence
ggtgtccatgggggcac

SEQ ID NO: 6092 - DNA, 17 bp, Artificial Sequence
  synthetic sequence
agaggctggggcaatgg

SEQ ID NO: 6093 - DNA, 17 bp, Artificial Sequence
  synthetic sequence
aacatgatgggaaagag

SEQ ID NO: 6094 - DNA, 17 bp, Artificial Sequence
  synthetic sequence
atacatccatttgccct

SEQ ID NO: 6095 - DNA, 17 bp, Artificial Sequence
  synthetic sequence
ccatggataccatcagt

SEQ ID NO: 6096 - DNA, 17 bp, Artificial Sequence
  synthetic sequence
gttattataggggtcct

SEQ ID NO: 6097 - DNA, 17 bp, Artificial Sequence
  synthetic sequence
tccagaatacgtgatgg

SEQ ID NO: 6098 - DNA, 17 bp, Artificial Sequence
  synthetic sequence
tgtcagcccagaaaccc

SEQ ID NO: 6099 - DNA, 17 bp, Artificial Sequence
  synthetic sequence
cacagctcgccgacacc

SEQ ID NO: 6100 - DNA, 17 bp, Artificial Sequence
  synthetic sequence
gcaatcaataaaggtat

SEQ ID NO: 6101 - DNA, 17 bp, Artificial Sequence
  synthetic sequence
attattacctttaagga

SEQ ID NO: 6102 - DNA, 17 bp, Artificial Sequence
  synthetic sequence
cagcaatcaaagctggc

SEQ ID NO: 6103 - DNA, 17 bp, Artificial Sequence
  synthetic sequence
accagtgaggacaatgc

SEQ ID NO: 6104 - DNA, 17 bp, Artificial Sequence
  synthetic sequence
tggaatattgtgacttt

SEQ ID NO: 6105 - DNA, 17 bp, Artificial Sequence
  synthetic sequence
accatacttatgaccgc

SEQ ID NO: 6106 - DNA, 17 bp, Artificial Sequence
  synthetic sequence
actgtcaatcctattgc

SEQ ID NO: 6107 - DNA, 17 bp, Artificial Sequence
  synthetic sequence
aaaactttttgggtcca

SEQ ID NO: 6108 - DNA, 17 bp, Artificial Sequence
  synthetic sequence
ggtgcccagtggaagga

SEQ ID NO: 6109 - DNA, 17 bp, Artificial Sequence
  synthetic sequence
ctgttgtcataataggg

SEQ ID NO: 6110 - DNA, 17 bp, Artificial Sequence
  synthetic sequence
agaagaaaccggatttc

SEQ ID NO: 6111 - DNA, 17 bp, Artificial Sequence
  synthetic sequence
ggcctgctcatgggctt

SEQ ID NO: 6112 - DNA, 17 bp, Artificial Sequence
  synthetic sequence
ttgtggaatggacccat

SEQ ID NO: 6113 - DNA, 17 bp, Artificial Sequence
  synthetic sequence
ctgaagctgaaatggtg

SEQ ID NO: 6114 - DNA, 17 bp, Artificial Sequence
  synthetic sequence
tgacggattgcagtatg

SEQ ID NO: 6115 - DNA, 17 bp, Artificial Sequence
  synthetic sequence
ttgggcttctgtgaagg

SEQ ID NO: 6116 - DNA, 17 bp, Artificial Sequence
  synthetic sequence
cagggttgttttgtcag

SEQ ID NO: 6117 - DNA, 17 bp, Artificial Sequence
  synthetic sequence
ggacagtctatgtggga

SEQ ID NO: 6118 - DNA, 17 bp, Artificial Sequence
  synthetic sequence
ttgaggggaacactagt

SEQ ID NO: 6119 - DNA, 17 bp, Artificial Sequence
  synthetic sequence
ccatggactaaagactc

SEQ ID NO: 6120 - DNA, 17 bp, Artificial Sequence
  synthetic sequence
atctgtgggaaaaggaa

SEQ ID NO: 6121 - DNA, 17 bp, Artificial Sequence
  synthetic sequence
caggagaagttcatgca

SEQ ID NO: 6122 - DNA, 17 bp, Artificial Sequence
  synthetic sequence
ggaagatcatgaaggtg

SEQ ID NO: 6123 - DNA, 17 bp, Artificial Sequence
  synthetic sequence
agagaagttcacagact

SEQ ID NO: 6124 - DNA, 17 bp, Artificial Sequence
  synthetic sequence
ggacacacgcatcacag

SEQ ID NO: 6125 - DNA, 17 bp, Artificial Sequence
  synthetic sequence
acatggcacgacgacac

SEQ ID NO: 6126 - DNA, 17 bp, Artificial Sequence
  synthetic sequence
caatgaccgcaaatggt

SEQ ID NO: 6127 - DNA, 17 bp, Artificial Sequence
  synthetic sequence
gtgtttggttctgcctt

SEQ ID NO: 6128 - DNA, 17 bp, Artificial Sequence
  synthetic sequence
ctgctcatcggcttcgg

SEQ ID NO: 6129 - DNA, 17 bp, Artificial Sequence
  synthetic sequence
aatgagggttacaaagg

SEQ ID NO: 6130 - DNA, 17 bp, Artificial Sequence
  synthetic sequence
tggtctgcagtatggtt

SEQ ID NO: 6131 - DNA, 17 bp, Artificial Sequence
  synthetic sequence
tgcactctgaggaaggt

SEQ ID NO: 6132 - DNA, 17 bp, Artificial Sequence
  synthetic sequence
cggtaatcaggaatccc

SEQ ID NO: 6133 - DNA, 17 bp, Artificial Sequence
  synthetic sequence
ccgtcatcaggaatcct

SEQ ID NO: 6134 - DNA, 17 bp, Artificial Sequence
  synthetic sequence
cccacacatgaaaacca

SEQ ID NO: 6135 - DNA, 17 bp, Artificial Sequence
  synthetic sequence
tgctcccaccacttcca

SEQ ID NO: 6136 - DNA, 17 bp, Artificial Sequence
  synthetic sequence
acagctgaggacttggg

SEQ ID NO: 6137 - DNA, 17 bp, Artificial Sequence
  synthetic sequence
ggtgctttgaaggaccc

SEQ ID NO: 6138 - DNA, 17 bp, Artificial Sequence
  synthetic sequence
tggagggtctcctctaa

SEQ ID NO: 6139 - DNA, 17 bp, Artificial Sequence
  synthetic sequence
tcatccaaaggtctgct

SEQ ID NO: 6140 - DNA, 17 bp, Artificial Sequence
  synthetic sequence
atggctgccattcagat

SEQ ID NO: 6141 - DNA, 17 bp, Artificial Sequence
  synthetic sequence
gtgtattcaaagactgc

SEQ ID NO: 6142 - DNA, 17 bp, Artificial Sequence
  synthetic sequence
gctggtggatcctttgc

SEQ ID NO: 6143 - DNA, 17 bp, Artificial Sequence
  synthetic sequence
caatgcgccccctcctt

SEQ ID NO: 6144 - DNA, 17 bp, Artificial Sequence
  synthetic sequence
accaccacactctttcc

SEQ ID NO: 6145 - DNA, 17 bp, Artificial Sequence
  synthetic sequence
ccaaacctcctttggag

SEQ ID NO: 6146 - DNA, 17 bp, Artificial Sequence
  synthetic sequence
cgtcaatatggtcccac

SEQ ID NO: 6147 - DNA, 17 bp, Artificial Sequence
  synthetic sequence
tctctcttgccaaagtt

SEQ ID NO: 6148 - DNA, 17 bp, Artificial Sequence
  synthetic sequence
gggagttcactcagcac

SEQ ID NO: 6149 - DNA, 17 bp, Artificial Sequence
  synthetic sequence
gtgacatgccacattgt

SEQ ID NO: 6150 - DNA, 17 bp, Artificial Sequence
  synthetic sequence
agccttggccacttgcc

SEQ ID NO: 6151 - DNA, 17 bp, Artificial Sequence
  synthetic sequence
ttggtcattccaatcag

SEQ ID NO: 6152 - DNA, 17 bp, Artificial Sequence
  synthetic sequence
ggtttgacgcctccaag

SEQ ID NO: 6153 - DNA, 17 bp, Artificial Sequence
  synthetic sequence
caggtgtcaacagagcc

SEQ ID NO: 6154 - DNA, 17 bp, Artificial Sequence
  synthetic sequence
ccaccatccattgcagc

SEQ ID NO: 6155 - DNA, 17 bp, Artificial Sequence
  synthetic sequence
gctaggacaatgccttc

SEQ ID NO: 6156 - DNA, 17 bp, Artificial Sequence
  synthetic sequence
gacctgcctgctgagtc

SEQ ID NO: 6157 - DNA, 17 bp, Artificial Sequence
  synthetic sequence
tacacacaagtccgaca

SEQ ID NO: 6158 - DNA, 17 bp, Artificial Sequence
  synthetic sequence
cagtcctgccagcactc

SEQ ID NO: 6159 - DNA, 17 bp, Artificial Sequence
  synthetic sequence
cagactttgcacattca

SEQ ID NO: 6160 - DNA, 17 bp, Artificial Sequence
  synthetic sequence
accaaggtcactccacc

SEQ ID NO: 6161 - DNA, 17 bp, Artificial Sequence
  synthetic sequence
gaggtcatcacaacctg

SEQ ID NO: 6162 - DNA, 17 bp, Artificial Sequence
  synthetic sequence
gcagcaatcaacgccat

SEQ ID NO: 6163 - DNA, 17 bp, Artificial Sequence
  synthetic sequence
aatgcagtgagctgagt

SEQ ID NO: 6164 - DNA, 17 bp, Artificial Sequence
  synthetic sequence
catcagctactatcact

SEQ ID NO: 6165 - DNA, 17 bp, Artificial Sequence
  synthetic sequence
tccacctccacaatgtc

SEQ ID NO: 6166 - DNA, 17 bp, Artificial Sequence
  synthetic sequence
aacattctttggatcct

SEQ ID NO: 6167 - DNA, 17 bp, Artificial Sequence
  synthetic sequence
tcaagatccggccaact

SEQ ID NO: 6168 - DNA, 17 bp, Artificial Sequence
  synthetic sequence
tcatgtcccttttgtga

SEQ ID NO: 6169 - DNA, 17 bp, Artificial Sequence
  synthetic sequence
tttcaaggagccttcct

SEQ ID NO: 6170 - DNA, 17 bp, Artificial Sequence
  synthetic sequence
ggagtccggttctccag

SEQ ID NO: 6171 - DNA, 17 bp, Artificial Sequence
  synthetic sequence
tttcttctatggcctct

SEQ ID NO: 6172 - DNA, 17 bp, Artificial Sequence
  synthetic sequence
accctatgccacagagc

SEQ ID NO: 6173 - DNA, 17 bp, Artificial Sequence
  synthetic sequence
cctgacagggcatcaaa

SEQ ID NO: 6174 - DNA, 17 bp, Artificial Sequence
  synthetic sequence
agtcaagagcgacagcc

SEQ ID NO: 6175 - DNA, 17 bp, Artificial Sequence
  synthetic sequence
ttcagagcataagtcac

SEQ ID NO: 6176 - DNA, 17 bp, Artificial Sequence
  synthetic sequence
ccagggatatgattgtg

SEQ ID NO: 6177 - DNA, 17 bp, Artificial Sequence
  synthetic sequence
aagagtgcgcaagcgtc

SEQ ID NO: 6178 - DNA, 17 bp, Artificial Sequence
  synthetic sequence
tagctctgtgcgctgcc

SEQ ID NO: 6179 - DNA, 17 bp, Artificial Sequence
  synthetic sequence
ctcccatgacggccagg

SEQ ID NO: 6180 - DNA, 17 bp, Artificial Sequence
  synthetic sequence
ttctcttcagctaggtg

SEQ ID NO: 6181 - DNA, 17 bp, Artificial Sequence
  synthetic sequence
ccttggcctaatttcca

SEQ ID NO: 6182 - DNA, 17 bp, Artificial Sequence
  synthetic sequence
gtggatgtgagatgccc

SEQ ID NO: 6183 - DNA, 17 bp, Artificial Sequence
  synthetic sequence
accctctcttcaatggc

SEQ ID NO: 6184 - DNA, 17 bp, Artificial Sequence
  synthetic sequence
agcctcatgtccctctt

SEQ ID NO: 6185 - DNA, 17 bp, Artificial Sequence
  synthetic sequence
tacccagtgaactcggc

SEQ ID NO: 6186 - DNA, 17 bp, Artificial Sequence
  synthetic sequence
tgccacatcgtgtggaa

SEQ ID NO: 6187 - DNA, 17 bp, Artificial Sequence
  synthetic sequence
gaataggctgggccaac

SEQ ID NO: 6188 - DNA, 17 bp, Artificial Sequence
  synthetic sequence
gctgaatcacacttgcc

SEQ ID NO: 6189 - DNA, 17 bp, Artificial Sequence
  synthetic sequence
actcccacgagaccagc

SEQ ID NO: 6190 - DNA, 17 bp, Artificial Sequence
  synthetic sequence
gaagcatggcgcatcca

SEQ ID NO: 6191 - DNA, 17 bp, Artificial Sequence
  synthetic sequence
ctcgggtagtcaagggc

SEQ ID NO: 6192 - DNA, 17 bp, Artificial Sequence
  synthetic sequence
cctctggctgctatgct

SEQ ID NO: 6193 - DNA, 17 bp, Artificial Sequence
  synthetic sequence
caagtgtgcgcaaccgt

SEQ ID NO: 6194 - DNA, 17 bp, Artificial Sequence
  synthetic sequence
atgtctgtccgtttata

SEQ ID NO: 6195 - DNA, 17 bp, Artificial Sequence
  synthetic sequence
ccaccactgagatgtct

SEQ ID NO: 6196 - DNA, 17 bp, Artificial Sequence
  synthetic sequence
ccttcctttccaagggt

SEQ ID NO: 6197 - DNA, 17 bp, Artificial Sequence
  synthetic sequence
catgtgttttccttggc

SEQ ID NO: 6198 - DNA, 17 bp, Artificial Sequence
  synthetic sequence
cacctgccctgctgatg

SEQ ID NO: 6199 - DNA, 17 bp, Artificial Sequence
  synthetic sequence
gccagcacaatgccttc

SEQ ID NO: 6200 - DNA, 17 bp, Artificial Sequence
  synthetic sequence
gcatagaatccaccacc

SEQ ID NO: 6201 - DNA, 17 bp, Artificial Sequence
  synthetic sequence
tctccttcattttcttc

SEQ ID NO: 6202 - DNA, 17 bp, Artificial Sequence
  synthetic sequence
cagcatcccccatgacg

SEQ ID NO: 6203 - DNA, 17 bp, Artificial Sequence
  synthetic sequence
tcatgtgtcttctttgg

SEQ ID NO: 6204 - DNA, 17 bp, Artificial Sequence
  synthetic sequence
aaacaggcaggtcacag

SEQ ID NO: 6205 - DNA, 17 bp, Artificial Sequence
  synthetic sequence
catcagcagcattccca

SEQ ID NO: 6206 - DNA, 17 bp, Artificial Sequence
  synthetic sequence
tcaaagtctggccagct

SEQ ID NO: 6207 - DNA, 17 bp, Artificial Sequence
  synthetic sequence
tacatggcatcccctcc

SEQ ID NO: 6208 - DNA, 17 bp, Artificial Sequence
  synthetic sequence
gctgtgagatcatcggc

SEQ ID NO: 6209 - DNA, 17 bp, Artificial Sequence
  synthetic sequence
ttcaggttggtgatggt

SEQ ID NO: 6210 - DNA, 17 bp, Artificial Sequence
  synthetic sequence
ttgtgggagctaactgg

SEQ ID NO: 6211 - DNA, 17 bp, Artificial Sequence
  synthetic sequence
tgatcccatggcacctt

SEQ ID NO: 6212 - DNA, 17 bp, Artificial Sequence
  synthetic sequence
ccaagggctaacacttt

SEQ ID NO: 6213 - DNA, 17 bp, Artificial Sequence
  synthetic sequence
tcaccatcattttcctc

SEQ ID NO: 6214 - DNA, 17 bp, Artificial Sequence
  synthetic sequence
ttttatcccggtttcag

SEQ ID NO: 6215 - DNA, 17 bp, Artificial Sequence
  synthetic sequence
tggggagtccggttctc

SEQ ID NO: 6216 - DNA, 17 bp, Artificial Sequence
  synthetic sequence
ccatcacagtccactga

SEQ ID NO: 6217 - DNA, 17 bp, Artificial Sequence
  synthetic sequence
ccacaatcacgggaatc

SEQ ID NO: 6218 - DNA, 17 bp, Artificial Sequence
  synthetic sequence
tggtcccagggcacttt

SEQ ID NO: 6219 - DNA, 17 bp, Artificial Sequence
  synthetic sequence
acagagccatgaggggc

SEQ ID NO: 6220 - DNA, 17 bp, Artificial Sequence
  synthetic sequence
acagcacatccttggtc

SEQ ID NO: 6221 - DNA, 17 bp, Artificial Sequence
  synthetic sequence
tcacccatcactgcaag

SEQ ID NO: 6222 - DNA, 17 bp, Artificial Sequence
  synthetic sequence
gagagcggtcttcaagg

SEQ ID NO: 6223 - DNA, 17 bp, Artificial Sequence
  synthetic sequence
ctttctaccaccacgtg

SEQ ID NO: 6224 - DNA, 17 bp, Artificial Sequence
  synthetic sequence
agatgttctttgggtct

SEQ ID NO: 6225 - DNA, 17 bp, Artificial Sequence
  synthetic sequence
aaacatgagatatccac

SEQ ID NO: 6226 - DNA, 17 bp, Artificial Sequence
  synthetic sequence
ccattctgaaatgtcct

SEQ ID NO: 6227 - DNA, 17 bp, Artificial Sequence
  synthetic sequence
ccagtgaattcagcctc

SEQ ID NO: 6228 - DNA, 17 bp, Artificial Sequence
  synthetic sequence
tcatggccatctctgcc

SEQ ID NO: 6229 - DNA, 17 bp, Artificial Sequence
  synthetic sequence
gtgccatcagggggagg

SEQ ID NO: 6230 - DNA, 17 bp, Artificial Sequence
  synthetic sequence
ccgctaaggaaaaaggg

SEQ ID NO: 6231 - DNA, 17 bp, Artificial Sequence
  synthetic sequence
ccagtttctctatcaca

SEQ ID NO: 6232 - DNA, 17 bp, Artificial Sequence
  synthetic sequence
tatgctagctggatcca

SEQ ID NO: 6233 - DNA, 17 bp, Artificial Sequence
  synthetic sequence
ccagcaggagggtcttt

SEQ ID NO: 6234 - DNA, 17 bp, Artificial Sequence
  synthetic sequence
cgtccaatgcgtcctct

SEQ ID NO: 6235 - DNA, 17 bp, Artificial Sequence
  synthetic sequence
tacatggcatctcctcc

SEQ ID NO: 6236 - DNA, 17 bp, Artificial Sequence
  synthetic sequence
ttggttatggtgttgag

SEQ ID NO: 6237 - DNA, 17 bp, Artificial Sequence
  synthetic sequence
ttctcgagaacatctgg

SEQ ID NO: 6238 - DNA, 17 bp, Artificial Sequence
  synthetic sequence
actcccaccaagccagc

SEQ ID NO: 6239 - DNA, 17 bp, Artificial Sequence
  synthetic sequence
gagcctgaggttccact

SEQ ID NO: 6240 - DNA, 17 bp, Artificial Sequence
  synthetic sequence
cttcaactaggtgagcc

SEQ ID NO: 6241 - DNA, 17 bp, Artificial Sequence
  synthetic sequence
ccttgtaacccgggatg

SEQ ID NO: 6242 - DNA, 17 bp, Artificial Sequence
  synthetic sequence
tccaccaatgccgcaca

SEQ ID NO: 6243 - DNA, 17 bp, Artificial Sequence
  synthetic sequence
atgagccgcccagcctc

SEQ ID NO: 6244 - DNA, 17 bp, Artificial Sequence
  synthetic sequence
agatatccacagccggc

SEQ ID NO: 6245 - DNA, 17 bp, Artificial Sequence
  synthetic sequence
tacgctggaccaaccgc

SEQ ID NO: 6246 - DNA, 17 bp, Artificial Sequence
  synthetic sequence
atcacatcttccatagg

SEQ ID NO: 6247 - DNA, 17 bp, Artificial Sequence
  synthetic sequence
gccaacaaacccagtaa

SEQ ID NO: 6248 - DNA, 17 bp, Artificial Sequence
  synthetic sequence
tctggcacactccgcca

SEQ ID NO: 6249 - DNA, 17 bp, Artificial Sequence
  synthetic sequence
tcactaggtggctgtcg

SEQ ID NO: 6250 - DNA, 17 bp, Artificial Sequence
  synthetic sequence
aggccaactccatggga

SEQ ID NO: 6251 - DNA, 17 bp, Artificial Sequence
  synthetic sequence
atagcatccttatccaa

SEQ ID NO: 6252 - DNA, 17 bp, Artificial Sequence
  synthetic sequence
gccaaccacactggcaa

SEQ ID NO: 6253 - DNA, 17 bp, Artificial Sequence
  synthetic sequence
taaaaccctccaccttc

SEQ ID NO: 6254 - DNA, 17 bp, Artificial Sequence
  synthetic sequence
ctgatgaagtttgcgtt

SEQ ID NO: 6255 - DNA, 17 bp, Artificial Sequence
  synthetic sequence
cgctttccgcagcgagg

SEQ ID NO: 6256 - DNA, 17 bp, Artificial Sequence
  synthetic sequence
tcgggcaactccgtgag

SEQ ID NO: 6257 - DNA, 17 bp, Artificial Sequence
  synthetic sequence
tctgggagctcactcag

SEQ ID NO: 6258 - DNA, 17 bp, Artificial Sequence
  synthetic sequence
gcgtctcccatgacagc

SEQ ID NO: 6259 - DNA, 17 bp, Artificial Sequence
  synthetic sequence
tcaggttagtgatggtg

SEQ ID NO: 6260 - DNA, 17 bp, Artificial Sequence
  synthetic sequence
atgtacaaggtccagtt

SEQ ID NO: 6261 - DNA, 17 bp, Artificial Sequence
  synthetic sequence
agcctcatatccctctt

SEQ ID NO: 6262 - DNA, 17 bp, Artificial Sequence
  synthetic sequence
tctccgtgcacactcag

SEQ ID NO: 6263 - DNA, 17 bp, Artificial Sequence
  synthetic sequence
tctgcttattcttgagc

SEQ ID NO: 6264 - DNA, 17 bp, Artificial Sequence
  synthetic sequence
agtctcagaaaccaggt

SEQ ID NO: 6265 - DNA, 17 bp, Artificial Sequence
  synthetic sequence
agaaacatgaggtatcc

SEQ ID NO: 6266 - DNA, 17 bp, Artificial Sequence
  synthetic sequence
accaccacactcttccc

SEQ ID NO: 6267 - DNA, 17 bp, Artificial Sequence
  synthetic sequence
taagtcactacctgccc

SEQ ID NO: 6268 - DNA, 17 bp, Artificial Sequence
  synthetic sequence
ttatcccggtttctgtt

SEQ ID NO: 6269 - DNA, 17 bp, Artificial Sequence
  synthetic sequence
ctcccccttctttggtg

SEQ ID NO: 6270 - DNA, 13 bp, Artificial Sequence
  synthetic sequence
acttgggttgtgt

SEQ ID NO: 6271 - DNA, 13 bp, Artificial Sequence
  synthetic sequence
ggcctggttggca

SEQ ID NO: 6272 - DNA, 13 bp, Artificial Sequence
  synthetic sequence
gccactgtgagag

SEQ ID NO: 6273 - DNA, 13 bp, Artificial Sequence
  synthetic sequence
gagtcccgctgct

SEQ ID NO: 6274 - DNA, 13 bp, Artificial Sequence
  synthetic sequence
gggaagatgggct

SEQ ID NO: 6275 - DNA, 13 bp, Artificial Sequence
  synthetic sequence
atgagagtggtga

SEQ ID NO: 6276 - DNA, 13 bp, Artificial Sequence
  synthetic sequence
gttggagtgggag

SEQ ID NO: 6277 - DNA, 13 bp, Artificial Sequence
  synthetic sequence
ccaacacaaggtg

SEQ ID NO: 6278 - DNA, 13 bp, Artificial Sequence
  synthetic sequence
ccatgcctgtcac

SEQ ID NO: 6279 - DNA, 13 bp, Artificial Sequence
  synthetic sequence
ctcacaaggagtg

SEQ ID NO: 6280 - DNA, 13 bp, Artificial Sequence
  synthetic sequence
caaaatcatatgc

SEQ ID NO: 6281 - DNA, 13 bp, Artificial Sequence
  synthetic sequence
agactgcgacagt

SEQ ID NO: 6282 - DNA, 13 bp, Artificial Sequence
  synthetic sequence
ttcttcctgaaat

SEQ ID NO: 6283 - DNA, 13 bp, Artificial Sequence
  synthetic sequence
gcctcctgctgac

SEQ ID NO: 6284 - DNA, 13 bp, Artificial Sequence
  synthetic sequence
tgccagccggact

SEQ ID NO: 6285 - DNA, 13 bp, Artificial Sequence
  synthetic sequence
ttgtggaggatca

SEQ ID NO: 6286 - DNA, 13 bp, Artificial Sequence
  synthetic sequence
gccccggcataca

SEQ ID NO: 6287 - DNA, 13 bp, Artificial Sequence
  synthetic sequence
atctaatgggaag

SEQ ID NO: 6288 - DNA, 13 bp, Artificial Sequence
  synthetic sequence
tcaatgagtgacc

SEQ ID NO: 6289 - DNA, 13 bp, Artificial Sequence
  synthetic sequence
ccatacaccagca

SEQ ID NO: 6290 - DNA, 13 bp, Artificial Sequence
  synthetic sequence
aaaggaagacctt

SEQ ID NO: 6291 - DNA, 13 bp, Artificial Sequence
  synthetic sequence
cagtcacagtgga

SEQ ID NO: 6292 - DNA, 13 bp, Artificial Sequence
  synthetic sequence
cacaatgccccca

SEQ ID NO: 6293 - DNA, 13 bp, Artificial Sequence
  synthetic sequence
aggttcttgaatg

SEQ ID NO: 6294 - DNA, 13 bp, Artificial Sequence
  synthetic sequence
atcatacccaagt

SEQ ID NO: 6295 - DNA, 13 bp, Artificial Sequence
  synthetic sequence
aaggggagctcaa

SEQ ID NO: 6296 - DNA, 13 bp, Artificial Sequence
  synthetic sequence
tgggctctagtgg

SEQ ID NO: 6297 - DNA, 13 bp, Artificial Sequence
  synthetic sequence
tcatagcagtagc

SEQ ID NO: 6298 - DNA, 13 bp, Artificial Sequence
  synthetic sequence
cagttatggacat

SEQ ID NO: 6299 - DNA, 13 bp, Artificial Sequence
  synthetic sequence
gacatgaaactga

SEQ ID NO: 6300 - DNA, 13 bp, Artificial Sequence
  synthetic sequence
cagatgtcggccc

SEQ ID NO: 6301 - DNA, 13 bp, Artificial Sequence
  synthetic sequence
gaatagccatgac

SEQ ID NO: 6302 - DNA, 13 bp, Artificial Sequence
  synthetic sequence
gaggagcggcttt

SEQ ID NO: 6303 - DNA, 13 bp, Artificial Sequence
  synthetic sequence
gttccaagcgtga

SEQ ID NO: 6304 - DNA, 13 bp, Artificial Sequence
  synthetic sequence
aaaggatggggac

SEQ ID NO: 6305 - DNA, 13 bp, Artificial Sequence
  synthetic sequence
ccatccgcaaagt

SEQ ID NO: 6306 - DNA, 13 bp, Artificial Sequence
  synthetic sequence
gcccacttcacag

SEQ ID NO: 6307 - DNA, 13 bp, Artificial Sequence
  synthetic sequence
gagttcaaggacg

SEQ ID NO: 6308 - DNA, 13 bp, Artificial Sequence
  synthetic sequence
gctgcgctgaagc

SEQ ID NO: 6309 - DNA, 13 bp, Artificial Sequence
  synthetic sequence
tgcttggccttag

SEQ ID NO: 6310 - DNA, 13 bp, Artificial Sequence
  synthetic sequence
gactcggatatgt

SEQ ID NO: 6311 - DNA, 13 bp, Artificial Sequence
  synthetic sequence
tgggaaaaaggga

SEQ ID NO: 6312 - DNA, 13 bp, Artificial Sequence
  synthetic sequence
tgggaaaccaagc

SEQ ID NO: 6313 - DNA, 13 bp, Artificial Sequence
  synthetic sequence
atcaacaggtttt

SEQ ID NO: 6314 - DNA, 13 bp, Artificial Sequence
  synthetic sequence
agctgtggcaagc

SEQ ID NO: 6315 - DNA, 13 bp, Artificial Sequence
  synthetic sequence
agtgatgatcttc

SEQ ID NO: 6316 - DNA, 13 bp, Artificial Sequence
  synthetic sequence
caggaatagctat

SEQ ID NO: 6317 - DNA, 13 bp, Artificial Sequence
  synthetic sequence
ttctagaagaaat

SEQ ID NO: 6318 - DNA, 13 bp, Artificial Sequence
  synthetic sequence
ccacgccaagagg

SEQ ID NO: 6319 - DNA, 13 bp, Artificial Sequence
  synthetic sequence
tgggccctagtgg

SEQ ID NO: 6320 - DNA, 13 bp, Artificial Sequence
  synthetic sequence
ttccaagtgtgag

SEQ ID NO: 6321 - DNA, 13 bp, Artificial Sequence
  synthetic sequence
ggatacacaaagg

SEQ ID NO: 6322 - DNA, 13 bp, Artificial Sequence
  synthetic sequence
gacggctgctggt

SEQ ID NO: 6323 - DNA, 13 bp, Artificial Sequence
  synthetic sequence
ctgggaaaagagg

SEQ ID NO: 6324 - DNA, 13 bp, Artificial Sequence
  synthetic sequence
ttcaagacaaagg

SEQ ID NO: 6325 - DNA, 13 bp, Artificial Sequence
  synthetic sequence
tggacatcatctc

SEQ ID NO: 6326 - DNA, 13 bp, Artificial Sequence
  synthetic sequence
atcctagaggaga

SEQ ID NO: 6327 - DNA, 13 bp, Artificial Sequence
  synthetic sequence
tacatcatggatg

SEQ ID NO: 6328 - DNA, 13 bp, Artificial Sequence
  synthetic sequence
ggagagaagtgga

SEQ ID NO: 6329 - DNA, 13 bp, Artificial Sequence
  synthetic sequence
aaagtcgaggtta

SEQ ID NO: 6330 - DNA, 13 bp, Artificial Sequence
  synthetic sequence
gtcatgaaaaacc

SEQ ID NO: 6331 - DNA, 13 bp, Artificial Sequence
  synthetic sequence
tggatatatccta

SEQ ID NO: 6332 - DNA, 13 bp, Artificial Sequence
  synthetic sequence
gtgatctgatcat

SEQ ID NO: 6333 - DNA, 13 bp, Artificial Sequence
  synthetic sequence
ggggacattggag

SEQ ID NO: 6334 - DNA, 13 bp, Artificial Sequence
  synthetic sequence
cttatggtgtgga

SEQ ID NO: 6335 - DNA, 13 bp, Artificial Sequence
  synthetic sequence
ttacagtggaggt

SEQ ID NO: 6336 - DNA, 13 bp, Artificial Sequence
  synthetic sequence
tgatgggtgccac

SEQ ID NO: 6337 - DNA, 13 bp, Artificial Sequence
  synthetic sequence
gggccatggaccc

SEQ ID NO: 6338 - DNA, 13 bp, Artificial Sequence
  synthetic sequence
aggactgggactg

SEQ ID NO: 6339 - DNA, 13 bp, Artificial Sequence
  synthetic sequence
ctccagcgccata

SEQ ID NO: 6340 - DNA, 13 bp, Artificial Sequence
  synthetic sequence
aactcttggggcc

SEQ ID NO: 6341 - DNA, 13 bp, Artificial Sequence
  synthetic sequence
agctggcccccta

SEQ ID NO: 6342 - DNA, 13 bp, Artificial Sequence
  synthetic sequence
ctacagccatggc

SEQ ID NO: 6343 - DNA, 13 bp, Artificial Sequence
  synthetic sequence
gagtccccaacta

SEQ ID NO: 6344 - DNA, 13 bp, Artificial Sequence
  synthetic sequence
cggcaatgagatc

SEQ ID NO: 6345 - DNA, 13 bp, Artificial Sequence
  synthetic sequence
aaaagaggagatc

SEQ ID NO: 6346 - DNA, 13 bp, Artificial Sequence
  synthetic sequence
gagcaaaggaaaa

SEQ ID NO: 6347 - DNA, 13 bp, Artificial Sequence
  synthetic sequence
gtggtgtggatct

SEQ ID NO: 6348 - DNA, 13 bp, Artificial Sequence
  synthetic sequence
tccgggctaaaga

SEQ ID NO: 6349 - DNA, 13 bp, Artificial Sequence
  synthetic sequence
ctgctgggttcaa

SEQ ID NO: 6350 - DNA, 13 bp, Artificial Sequence
  synthetic sequence
caattaacacccc

SEQ ID NO: 6351 - DNA, 13 bp, Artificial Sequence
  synthetic sequence
ctgctgggtcatg

SEQ ID NO: 6352 - DNA, 13 bp, Artificial Sequence
  synthetic sequence
tctccagtgctgt

SEQ ID NO: 6353 - DNA, 13 bp, Artificial Sequence
  synthetic sequence
atacttggtcatg

SEQ ID NO: 6354 - DNA, 13 bp, Artificial Sequence
  synthetic sequence
tttccacagaagg

SEQ ID NO: 6355 - DNA, 13 bp, Artificial Sequence
  synthetic sequence
atgccctcaggtt

SEQ ID NO: 6356 - DNA, 13 bp, Artificial Sequence
  synthetic sequence
ctgtgcccataca

SEQ ID NO: 6357 - DNA, 13 bp, Artificial Sequence
  synthetic sequence
cggaggatccgga

SEQ ID NO: 6358 - DNA, 13 bp, Artificial Sequence
  synthetic sequence
ttgagattcacgg

SEQ ID NO: 6359 - DNA, 13 bp, Artificial Sequence
  synthetic sequence
tcctctaaccact

SEQ ID NO: 6360 - DNA, 13 bp, Artificial Sequence
  synthetic sequence
atggcatcccttt

SEQ ID NO: 6361 - DNA, 13 bp, Artificial Sequence
  synthetic sequence
ttcactggcctcc

SEQ ID NO: 6362 - DNA, 13 bp, Artificial Sequence
  synthetic sequence
tggcatggcacat

SEQ ID NO: 6363 - DNA, 13 bp, Artificial Sequence
  synthetic sequence
ctctgccacatcc

SEQ ID NO: 6364 - DNA, 13 bp, Artificial Sequence
  synthetic sequence
cttcaaatattgc

SEQ ID NO: 6365 - DNA, 13 bp, Artificial Sequence
  synthetic sequence
gatccattctttg

SEQ ID NO: 6366 - DNA, 13 bp, Artificial Sequence
  synthetic sequence
gccattgatgtgc

SEQ ID NO: 6367 - DNA, 13 bp, Artificial Sequence
  synthetic sequence
accactttgtttt

SEQ ID NO: 6368 - DNA, 13 bp, Artificial Sequence
  synthetic sequence
agcaccattcctc

SEQ ID NO: 6369 - DNA, 13 bp, Artificial Sequence
  synthetic sequence
gttagctgcttct

SEQ ID NO: 6370 - DNA, 13 bp, Artificial Sequence
  synthetic sequence
ctccagtcaccac

SEQ ID NO: 6371 - DNA, 13 bp, Artificial Sequence
  synthetic sequence
ggatgctccatcc

SEQ ID NO: 6372 - DNA, 13 bp, Artificial Sequence
  synthetic sequence
ttgtcattgtgtc

SEQ ID NO: 6373 - DNA, 13 bp, Artificial Sequence
  synthetic sequence
atgttttccattc

SEQ ID NO: 6374 - DNA, 13 bp, Artificial Sequence
  synthetic sequence
tcctagcattgat

SEQ ID NO: 6375 - DNA, 13 bp, Artificial Sequence
  synthetic sequence
atgttttcatctc

SEQ ID NO: 6376 - DNA, 13 bp, Artificial Sequence
  synthetic sequence
atgtctgtccatt

SEQ ID NO: 6377 - DNA, 13 bp, Artificial Sequence
  synthetic sequence
actcctatgacaa

SEQ ID NO: 6378 - DNA, 13 bp, Artificial Sequence
  synthetic sequence
tccaggctctctc

SEQ ID NO: 6379 - DNA, 13 bp, Artificial Sequence
  synthetic sequence
tttcccatgtgat

SEQ ID NO: 6380 - DNA, 13 bp, Artificial Sequence
  synthetic sequence
actctccctcaat

SEQ ID NO: 6381 - DNA, 13 bp, Artificial Sequence
  synthetic sequence
actttttggctcg

SEQ ID NO: 6382 - DNA, 13 bp, Artificial Sequence
  synthetic sequence
tacactccatctg

SEQ ID NO: 6383 - DNA, 13 bp, Artificial Sequence
  synthetic sequence
ttcagtgtgtcac

SEQ ID NO: 6384 - DNA, 13 bp, Artificial Sequence
  synthetic sequence
tttaggcatctcc

SEQ ID NO: 6385 - DNA, 13 bp, Artificial Sequence
  synthetic sequence
taggatcttacct

SEQ ID NO: 6386 - DNA, 13 bp, Artificial Sequence
  synthetic sequence
ccagtgtggagtt

SEQ ID NO: 6387 - DNA, 13 bp, Artificial Sequence
  synthetic sequence
ttcaagaatccaa

SEQ ID NO: 6388 - DNA, 13 bp, Artificial Sequence
  synthetic sequence
gctgggagccatg

SEQ ID NO: 6389 - DNA, 13 bp, Artificial Sequence
  synthetic sequence
atgtgaacgctgc

SEQ ID NO: 6390 - DNA, 13 bp, Artificial Sequence
  synthetic sequence
catctggttccac

SEQ ID NO: 6391 - DNA, 13 bp, Artificial Sequence
  synthetic sequence
ccattcgtttgag

SEQ ID NO: 6392 - DNA, 13 bp, Artificial Sequence
  synthetic sequence
gcaggcctgacaa

SEQ ID NO: 6393 - DNA, 13 bp, Artificial Sequence
  synthetic sequence
gacttcagggccg

SEQ ID NO: 6394 - DNA, 13 bp, Artificial Sequence
  synthetic sequence
ctctctccggggg

SEQ ID NO: 6395 - DNA, 13 bp, Artificial Sequence
  synthetic sequence
agatcgcagtttg

SEQ ID NO: 6396 - DNA, 13 bp, Artificial Sequence
  synthetic sequence
ccacgtctcttga

SEQ ID NO: 6397 - DNA, 13 bp, Artificial Sequence
  synthetic sequence
actgttcccagca

SEQ ID NO: 6398 - DNA, 13 bp, Artificial Sequence
  synthetic sequence
cccagggccatga

SEQ ID NO: 6399 - DNA, 13 bp, Artificial Sequence
  synthetic sequence
catccgagttcat

SEQ ID NO: 6400 - DNA, 13 bp, Artificial Sequence
  synthetic sequence
cccccaccatgga

SEQ ID NO: 6401 - DNA, 13 bp, Artificial Sequence
  synthetic sequence
cggcgatctgtgc

SEQ ID NO: 6402 - DNA, 13 bp, Artificial Sequence
  synthetic sequence
tcacccaagtagc

SEQ ID NO: 6403 - DNA, 13 bp, Artificial Sequence
  synthetic sequence
agagcactctgag

SEQ ID NO: 6404 - DNA, 13 bp, Artificial Sequence
  synthetic sequence
gtctcttaaccag

SEQ ID NO: 6405 - DNA, 13 bp, Artificial Sequence
  synthetic sequence
ctggtctttccca

SEQ ID NO: 6406 - DNA, 13 bp, Artificial Sequence
  synthetic sequence
ccaaggccatgac

SEQ ID NO: 6407 - DNA, 13 bp, Artificial Sequence
  synthetic sequence
ttgcagttatcaa

SEQ ID NO: 6408 - DNA, 13 bp, Artificial Sequence
  synthetic sequence
aatcgacgtcatc

SEQ ID NO: 6409 - DNA, 13 bp, Artificial Sequence
  synthetic sequence
acgaggaccatca

SEQ ID NO: 6410 - DNA, 13 bp, Artificial Sequence
  synthetic sequence
ccatccacctcgg

SEQ ID NO: 6411 - DNA, 13 bp, Artificial Sequence
  synthetic sequence
tggtgaatgtgaa

SEQ ID NO: 6412 - DNA, 13 bp, Artificial Sequence
  synthetic sequence
ccgcatcaagaca

SEQ ID NO: 6413 - DNA, 13 bp, Artificial Sequence
  synthetic sequence
tggccctctctcc

SEQ ID NO: 6414 - DNA, 13 bp, Artificial Sequence
  synthetic sequence
acgaaaaagattc

SEQ ID NO: 6415 - DNA, 13 bp, Artificial Sequence
  synthetic sequence
aagggtggggaag

SEQ ID NO: 6416 - DNA, 13 bp, Artificial Sequence
  synthetic sequence
ctgatagcattat

SEQ ID NO: 6417 - DNA, 13 bp, Artificial Sequence
  synthetic sequence
gccatccgtttga

SEQ ID NO: 6418 - DNA, 13 bp, Artificial Sequence
  synthetic sequence
tccccatccagtg

SEQ ID NO: 6419 - DNA, 13 bp, Artificial Sequence
  synthetic sequence
gtgtctgccccag

SEQ ID NO: 6420 - DNA, 13 bp, Artificial Sequence
  synthetic sequence
tcttgtcctccat

SEQ ID NO: 6421 - DNA, 13 bp, Artificial Sequence
  synthetic sequence
gatattgatgcct

SEQ ID NO: 6422 - DNA, 13 bp, Artificial Sequence
  synthetic sequence
cccttcttcgccc

SEQ ID NO: 6423 - DNA, 13 bp, Artificial Sequence
  synthetic sequence
ccatctgtggtct

SEQ ID NO: 6424 - DNA, 13 bp, Artificial Sequence
  synthetic sequence
cagggctttgaca

SEQ ID NO: 6425 - DNA, 13 bp, Artificial Sequence
  synthetic sequence
gcatccatccatc

SEQ ID NO: 6426 - DNA, 13 bp, Artificial Sequence
  synthetic sequence
ttccagtgacttc

SEQ ID NO: 6427 - DNA, 13 bp, Artificial Sequence
  synthetic sequence
agaggagatcccg

SEQ ID NO: 6428 - DNA, 13 bp, Artificial Sequence
  synthetic sequence
tcccccaccatag

SEQ ID NO: 6429 - DNA, 13 bp, Artificial Sequence
  synthetic sequence
ttggccactcaca

SEQ ID NO: 6430 - DNA, 13 bp, Artificial Sequence
  synthetic sequence
ttcccatccagtg

SEQ ID NO: 6431 - DNA, 13 bp, Artificial Sequence
  synthetic sequence
tttgactcagtgt

SEQ ID NO: 6432 - DNA, 13 bp, Artificial Sequence
  synthetic sequence
cacaggctgcaca

SEQ ID NO: 6433 - DNA, 13 bp, Artificial Sequence
  synthetic sequence
acactggaactga

SEQ ID NO: 6434 - DNA, 13 bp, Artificial Sequence
  synthetic sequence
ctacacacgtgct

SEQ ID NO: 6435 - DNA, 13 bp, Artificial Sequence
  synthetic sequence
agtgaggaaggcc

SEQ ID NO: 6436 - DNA, 13 bp, Artificial Sequence
  synthetic sequence
cagggcttaaccc

SEQ ID NO: 6437 - DNA, 13 bp, Artificial Sequence
  synthetic sequence
acaccagtggcga

SEQ ID NO: 6438 - DNA, 13 bp, Artificial Sequence
  synthetic sequence
cacaggtgctgca

SEQ ID NO: 6439 - DNA, 13 bp, Artificial Sequence
  synthetic sequence
cgcggtaatacgg

SEQ ID NO: 6440 - DNA, 13 bp, Artificial Sequence
  synthetic sequence
aggaattgacggg

SEQ ID NO: 6441 - DNA, 13 bp, Artificial Sequence
  synthetic sequence
acgatgagtgctg

SEQ ID NO: 6442 - DNA, 13 bp, Artificial Sequence
  synthetic sequence
ttagttgccagcg

SEQ ID NO: 6443 - DNA, 13 bp, Artificial Sequence
  synthetic sequence
ccgggcactttaa

SEQ ID NO: 6444 - DNA, 13 bp, Artificial Sequence
  synthetic sequence
ttacctccgtgtt

SEQ ID NO: 6445 - DNA, 13 bp, Artificial Sequence
  synthetic sequence
aggaattgatggg

SEQ ID NO: 6446 - DNA, 13 bp, Artificial Sequence
  synthetic sequence
ccgtggcatgctg

SEQ ID NO: 6447 - DNA, 13 bp, Artificial Sequence
  synthetic sequence
cgggacttaaccc

SEQ ID NO: 6448 - DNA, 13 bp, Artificial Sequence
  synthetic sequence
ttgcgaccgtagt

SEQ ID NO: 6449 - DNA, 13 bp, Artificial Sequence
  synthetic sequence
atttcacctctac

SEQ ID NO: 6450 - DNA, 13 bp, Artificial Sequence
  synthetic sequence
cctacatgccctt

SEQ ID NO: 6451 - DNA, 13 bp, Artificial Sequence
  synthetic sequence
cccacgctttcgc

SEQ ID NO: 6452 - DNA, 13 bp, Artificial Sequence
  synthetic sequence
gtttgccgggact

SEQ ID NO: 6453 - DNA, 13 bp, Artificial Sequence
  synthetic sequence
gacttgacatcat

SEQ ID NO: 6454 - DNA, 13 bp, Artificial Sequence
  synthetic sequence
attagctcagcct

SEQ ID NO: 6455 - DNA, 13 bp, Artificial Sequence
  synthetic sequence
tcgcgttgcatcg

SEQ ID NO: 6456 - DNA, 13 bp, Artificial Sequence
  synthetic sequence
actgagatgactt

SEQ ID NO: 6457 - DNA, 13 bp, Artificial Sequence
  synthetic sequence
aaggtttttcgcg

SEQ ID NO: 6458 - DNA, 13 bp, Artificial Sequence
  synthetic sequence
tatcactggcagt

SEQ ID NO: 6459 - DNA, 13 bp, Artificial Sequence
  synthetic sequence
acggaataacaca

SEQ ID NO: 6460 - DNA, 13 bp, Artificial Sequence
  synthetic sequence
gtcgcaagattaa

SEQ ID NO: 6461 - DNA, 13 bp, Artificial Sequence
  synthetic sequence
ttgggttaagtcc

SEQ ID NO: 6462 - DNA, 13 bp, Artificial Sequence
  synthetic sequence
cgtcaagtcctca

SEQ ID NO: 6463 - DNA, 13 bp, Artificial Sequence
  synthetic sequence
caaaagccatctc

SEQ ID NO: 6464 - DNA, 13 bp, Artificial Sequence
  synthetic sequence
gggaggcagcagt

SEQ ID NO: 6465 - DNA, 13 bp, Artificial Sequence
  synthetic sequence
cgagtgtagaggt

SEQ ID NO: 6466 - DNA, 13 bp, Artificial Sequence
  synthetic sequence
ataccctggtagt

SEQ ID NO: 6467 - DNA, 13 bp, Artificial Sequence
  synthetic sequence
ccttgacatcccg

SEQ ID NO: 6468 - DNA, 13 bp, Artificial Sequence
  synthetic sequence
gtaggcggatatt

SEQ ID NO: 6469 - DNA, 13 bp, Artificial Sequence
  synthetic sequence
gttggattagcta

SEQ ID NO: 6470 - DNA, 13 bp, Artificial Sequence
  synthetic sequence
ggagaagaagccc

SEQ ID NO: 6471 - DNA, 13 bp, Artificial Sequence
  synthetic sequence
acgattactagcg

SEQ ID NO: 6472 - DNA, 13 bp, Artificial Sequence
  synthetic sequence
agtcccagtgtgg

SEQ ID NO: 6473 - DNA, 13 bp, Artificial Sequence
  synthetic sequence
ccaccgcttgtgc

SEQ ID NO: 6474 - DNA, 13 bp, Artificial Sequence
  synthetic sequence
gcaactaagggcg

SEQ ID NO: 6475 - DNA, 13 bp, Artificial Sequence
  synthetic sequence
ctttacaacccta

SEQ ID NO: 6476 - DNA, 13 bp, Artificial Sequence
  synthetic sequence
gagccgccttcgc

SEQ ID NO: 6477 - DNA, 13 bp, Artificial Sequence
  synthetic sequence
ctaacattcatcg

SEQ ID NO: 6478 - DNA, 13 bp, Artificial Sequence
  synthetic sequence
caaaggcagttcc

SEQ ID NO: 6479 - DNA, 13 bp, Artificial Sequence
  synthetic sequence
ccccttcgtatta

SEQ ID NO: 6480 - DNA, 13 bp, Artificial Sequence
  synthetic sequence
agcccagcccgta

SEQ ID NO: 6481 - DNA, 13 bp, Artificial Sequence
  synthetic sequence
tgcagcacctgtc

SEQ ID NO: 6482 - DNA, 13 bp, Artificial Sequence
  synthetic sequence
gtgcgtcttaagc

SEQ ID NO: 6483 - DNA, 13 bp, Artificial Sequence
  synthetic sequence
ttcttttataaat

SEQ ID NO: 6484 - DNA, 13 bp, Artificial Sequence
  synthetic sequence
gaggcagcagcta

SEQ ID NO: 6485 - DNA, 13 bp, Artificial Sequence
  synthetic sequence
acgctgagtcacg

SEQ ID NO: 6486 - DNA, 13 bp, Artificial Sequence
  synthetic sequence
tacaggtgctgca

SEQ ID NO: 6487 - DNA, 13 bp, Artificial Sequence
  synthetic sequence
gggtaaatgccta

SEQ ID NO: 6488 - DNA, 13 bp, Artificial Sequence
  synthetic sequence
actcagataagac

SEQ ID NO: 6489 - DNA, 13 bp, Artificial Sequence
  synthetic sequence
gttagtaccgaag

SEQ ID NO: 6490 - DNA, 13 bp, Artificial Sequence
  synthetic sequence
tgttggaaactat

SEQ ID NO: 6491 - DNA, 13 bp, Artificial Sequence
  synthetic sequence
tacaatggcctgt

SEQ ID NO: 6492 - DNA, 13 bp, Artificial Sequence
  synthetic sequence
ggagcatgtggtt

SEQ ID NO: 6493 - DNA, 13 bp, Artificial Sequence
  synthetic sequence
gcgtaaagggtga

SEQ ID NO: 6494 - DNA, 13 bp, Artificial Sequence
  synthetic sequence
agatggggataac

SEQ ID NO: 6495 - DNA, 13 bp, Artificial Sequence
  synthetic sequence
cattctgatatac

SEQ ID NO: 6496 - DNA, 13 bp, Artificial Sequence
  synthetic sequence
gggtatctaatcc

SEQ ID NO: 6497 - DNA, 13 bp, Artificial Sequence
  synthetic sequence
gactgagacctgc

SEQ ID NO: 6498 - DNA, 13 bp, Artificial Sequence
  synthetic sequence
tatgtcaagccct

SEQ ID NO: 6499 - DNA, 13 bp, Artificial Sequence
  synthetic sequence
cttcctttcatca

SEQ ID NO: 6500 - DNA, 13 bp, Artificial Sequence
  synthetic sequence
acaatctttcgac

SEQ ID NO: 6501 - DNA, 13 bp, Artificial Sequence
  synthetic sequence
gggacttaaccca

SEQ ID NO: 6502 - DNA, 13 bp, Artificial Sequence
  synthetic sequence
gcccaggacataa

SEQ ID NO: 6503 - DNA, 13 bp, Artificial Sequence
  synthetic sequence
ttgcgagcatact

SEQ ID NO: 6504 - DNA, 13 bp, Artificial Sequence
  synthetic sequence
tcgcctccggtat

SEQ ID NO: 6505 - DNA, 13 bp, Artificial Sequence
  synthetic sequence
ccagtgtgaccgt

SEQ ID NO: 6506 - DNA, 13 bp, Artificial Sequence
  synthetic sequence
cataaattaacgt

SEQ ID NO: 6507 - DNA, 13 bp, Artificial Sequence
  synthetic sequence
gacttatatatcc

SEQ ID NO: 6508 - DNA, 13 bp, Artificial Sequence
  synthetic sequence
attttatgcatag

SEQ ID NO: 6509 - DNA, 13 bp, Artificial Sequence
  synthetic sequence
gtggctttgtgct

SEQ ID NO: 6510 - DNA, 13 bp, Artificial Sequence
  synthetic sequence
atttaacaggtat

SEQ ID NO: 6511 - DNA, 13 bp, Artificial Sequence
  synthetic sequence
agttcaaggcagt

SEQ ID NO: 6512 - DNA, 13 bp, Artificial Sequence
  synthetic sequence
taattttaataat

SEQ ID NO: 6513 - DNA, 13 bp, Artificial Sequence
  synthetic sequence
tttgaggaggctg

SEQ ID NO: 6514 - DNA, 13 bp, Artificial Sequence
  synthetic sequence
aaatcaacttttt

SEQ ID NO: 6515 - DNA, 13 bp, Artificial Sequence
  synthetic sequence
ttaaagatccctc

SEQ ID NO: 6516 - DNA, 13 bp, Artificial Sequence
  synthetic sequence
aatttaaagttgg

SEQ ID NO: 6517 - DNA, 13 bp, Artificial Sequence
  synthetic sequence
tgcattattttct

SEQ ID NO: 6518 - DNA, 13 bp, Artificial Sequence
  synthetic sequence
aggctttaattac

SEQ ID NO: 6519 - DNA, 13 bp, Artificial Sequence
  synthetic sequence
gggcaaatagact

SEQ ID NO: 6520 - DNA, 13 bp, Artificial Sequence
  synthetic sequence
aggtataggtaat

SEQ ID NO: 6521 - DNA, 13 bp, Artificial Sequence
  synthetic sequence
gctgctaagaagg

SEQ ID NO: 6522 - DNA, 13 bp, Artificial Sequence
  synthetic sequence
tacaagtgtttaa

SEQ ID NO: 6523 - DNA, 13 bp, Artificial Sequence
  synthetic sequence
tacctatttcatt

SEQ ID NO: 6524 - DNA, 13 bp, Artificial Sequence
  synthetic sequence
tcctgatatcaaa

SEQ ID NO: 6525 - DNA, 13 bp, Artificial Sequence
  synthetic sequence
ttaatttaatttg

SEQ ID NO: 6526 - DNA, 13 bp, Artificial Sequence
  synthetic sequence
tcctgaagatatt

SEQ ID NO: 6527 - DNA, 13 bp, Artificial Sequence
  synthetic sequence
gctcaatttctac

SEQ ID NO: 6528 - DNA, 13 bp, Artificial Sequence
  synthetic sequence
atttgaaagcatt

SEQ ID NO: 6529 - DNA, 13 bp, Artificial Sequence
  synthetic sequence
cttttggtcccgc

SEQ ID NO: 6530 - DNA, 13 bp, Artificial Sequence
  synthetic sequence
tcccgtaaaaatt

SEQ ID NO: 6531 - DNA, 13 bp, Artificial Sequence
  synthetic sequence
atcttttaaagag

SEQ ID NO: 6532 - DNA, 13 bp, Artificial Sequence
  synthetic sequence
tatctcttaaatt

SEQ ID NO: 6533 - DNA, 13 bp, Artificial Sequence
  synthetic sequence
gacacacctccaa

SEQ ID NO: 6534 - DNA, 13 bp, Artificial Sequence
  synthetic sequence
accatttgctacg

SEQ ID NO: 6535 - DNA, 13 bp, Artificial Sequence
  synthetic sequence
tcgtgtcgtgaga

SEQ ID NO: 6536 - DNA, 13 bp, Artificial Sequence
  synthetic sequence
gttgttcggattt

SEQ ID NO: 6537 - DNA, 13 bp, Artificial Sequence
  synthetic sequence
tggcgcagctaac

SEQ ID NO: 6538 - DNA, 13 bp, Artificial Sequence
  synthetic sequence
agcccttgacatc

SEQ ID NO: 6539 - DNA, 13 bp, Artificial Sequence
  synthetic sequence
tctccaaaagcca

SEQ ID NO: 6540 - DNA, 13 bp, Artificial Sequence
  synthetic sequence
tatggaagaggtg

SEQ ID NO: 6541 - DNA, 13 bp, Artificial Sequence
  synthetic sequence
acggcccagactc

SEQ ID NO: 6542 - DNA, 13 bp, Artificial Sequence
  synthetic sequence
gtgataagccgag

SEQ ID NO: 6543 - DNA, 13 bp, Artificial Sequence
  synthetic sequence
gataatgacggta

SEQ ID NO: 6544 - DNA, 13 bp, Artificial Sequence
  synthetic sequence
ccgcgttggatta

SEQ ID NO: 6545 - DNA, 13 bp, Artificial Sequence
  synthetic sequence
gcgaaagcgtggg

SEQ ID NO: 6546 - DNA, 13 bp, Artificial Sequence
  synthetic sequence
gcgattccaactt

SEQ ID NO: 6547 - DNA, 13 bp, Artificial Sequence
  synthetic sequence
ttgagccccggga

SEQ ID NO: 6548 - DNA, 13 bp, Artificial Sequence
  synthetic sequence
cttcgccactggt

SEQ ID NO: 6549 - DNA, 13 bp, Artificial Sequence
  synthetic sequence
gctccaccgcttg

SEQ ID NO: 6550 - DNA, 13 bp, Artificial Sequence
  synthetic sequence
ggcacgaagttag

SEQ ID NO: 6551 - DNA, 13 bp, Artificial Sequence
  synthetic sequence
cggcgtggactac

SEQ ID NO: 6552 - DNA, 13 bp, Artificial Sequence
  synthetic sequence
tgtggctgatcat

SEQ ID NO: 6553 - DNA, 13 bp, Artificial Sequence
  synthetic sequence
actaaccgcgatc

SEQ ID NO: 6554 - DNA, 13 bp, Artificial Sequence
  synthetic sequence
atcactcacgcgg

SEQ ID NO: 6555 - DNA, 13 bp, Artificial Sequence
  synthetic sequence
agcccagcccgta

SEQ ID NO: 6556 - DNA, 13 bp, Artificial Sequence
  synthetic sequence
ccaactgaatgct

SEQ ID NO: 6557 - DNA, 13 bp, Artificial Sequence
  synthetic sequence
ggcggaagggtta

SEQ ID NO: 6558 - DNA, 13 bp, Artificial Sequence
  synthetic sequence
ctaataccgaatg

SEQ ID NO: 6559 - DNA, 13 bp, Artificial Sequence
  synthetic sequence
tcttcggaccttt

SEQ ID NO: 6560 - DNA, 13 bp, Artificial Sequence
  synthetic sequence
gccattactagca

SEQ ID NO: 6561 - DNA, 13 bp, Artificial Sequence
  synthetic sequence
ttaaaccacatgc

SEQ ID NO: 6562 - DNA, 13 bp, Artificial Sequence
  synthetic sequence
ctttccgcctaca

SEQ ID NO: 6563 - DNA, 13 bp, Artificial Sequence
  synthetic sequence
taagggttgcgct

SEQ ID NO: 6564 - DNA, 13 bp, Artificial Sequence
  synthetic sequence
acagccatgcagc

SEQ ID NO: 6565 - DNA, 13 bp, Artificial Sequence
  synthetic sequence
ctcctcaggcggc

SEQ ID NO: 6566 - DNA, 13 bp, Artificial Sequence
  synthetic sequence
taacgctagcacc

SEQ ID NO: 6567 - DNA, 13 bp, Artificial Sequence
  synthetic sequence
gtcagactttcgt

SEQ ID NO: 6568 - DNA, 13 bp, Artificial Sequence
  synthetic sequence
acgcatttcaccg

SEQ ID NO: 6569 - DNA, 13 bp, Artificial Sequence
  synthetic sequence
aaaagcgccttcg

SEQ ID NO: 6570 - DNA, 13 bp, Artificial Sequence
  synthetic sequence
tgcttctttacct

SEQ ID NO: 6571 - DNA, 13 bp, Artificial Sequence
  synthetic sequence
gattctcgactgc

SEQ ID NO: 6572 - DNA, 13 bp, Artificial Sequence
  synthetic sequence
ttgcagactacaa

SEQ ID NO: 6573 - DNA, 13 bp, Artificial Sequence
  synthetic sequence
taagggccatgct

SEQ ID NO: 6574 - DNA, 13 bp, Artificial Sequence
  synthetic sequence
cacatcaagtatg

SEQ ID NO: 6575 - DNA, 13 bp, Artificial Sequence
  synthetic sequence
gctaccttctgta

SEQ ID NO: 6576 - DNA, 13 bp, Artificial Sequence
  synthetic sequence
tctctcaatccgc

SEQ ID NO: 6577 - DNA, 13 bp, Artificial Sequence
  synthetic sequence
tctaatcctgttt

SEQ ID NO: 6578 - DNA, 13 bp, Artificial Sequence
  synthetic sequence
taccccaccaaca

SEQ ID NO: 6579 - DNA, 13 bp, Artificial Sequence
  synthetic sequence
agtgctttacaac

SEQ ID NO: 6580 - DNA, 13 bp, Artificial Sequence
  synthetic sequence
acccaggcagtct

SEQ ID NO: 6581 - DNA, 13 bp, Artificial Sequence
  synthetic sequence
aatacatgtcaag

SEQ ID NO: 6582 - DNA, 13 bp, Artificial Sequence
  synthetic sequence
gatagtattagat

SEQ ID NO: 6583 - DNA, 13 bp, Artificial Sequence
  synthetic sequence
atcctctagaaag

SEQ ID NO: 6584 - DNA, 13 bp, Artificial Sequence
  synthetic sequence
aggtaaggttctt

SEQ ID NO: 6585 - DNA, 13 bp, Artificial Sequence
  synthetic sequence
gcgagtggcggac

SEQ ID NO: 6586 - DNA, 13 bp, Artificial Sequence
  synthetic sequence
tctgagaggacga

SEQ ID NO: 6587 - DNA, 13 bp, Artificial Sequence
  synthetic sequence
ccctggtagtcca

SEQ ID NO: 6588 - DNA, 13 bp, Artificial Sequence
  synthetic sequence
tgtgaaagccctg

SEQ ID NO: 6589 - DNA, 13 bp, Artificial Sequence
  synthetic sequence
cttacgggtaggg

SEQ ID NO: 6590 - DNA, 13 bp, Artificial Sequence
  synthetic sequence
gaaagaacaccag

SEQ ID NO: 6591 - DNA, 13 bp, Artificial Sequence
  synthetic sequence
ctgtgccagcagc

SEQ ID NO: 6592 - DNA, 13 bp, Artificial Sequence
  synthetic sequence
tgacatcctcgga

SEQ ID NO: 6593 - DNA, 13 bp, Artificial Sequence
  synthetic sequence
aggccttcgggtt

SEQ ID NO: 6594 - DNA, 13 bp, Artificial Sequence
  synthetic sequence
caaccctcgtcct

SEQ ID NO: 6595 - DNA, 13 bp, Artificial Sequence
  synthetic sequence
taatctctttgga

SEQ ID NO: 6596 - DNA, 13 bp, Artificial Sequence
  synthetic sequence
caaggttaaaact

SEQ ID NO: 6597 - DNA, 13 bp, Artificial Sequence
  synthetic sequence
actagcgattcca

SEQ ID NO: 6598 - DNA, 13 bp, Artificial Sequence
  synthetic sequence
aagatacccagta

SEQ ID NO: 6599 - DNA, 13 bp, Artificial Sequence
  synthetic sequence
cgcccaaggatat

SEQ ID NO: 6600 - DNA, 13 bp, Artificial Sequence
  synthetic sequence
ttttcgcgttgca

SEQ ID NO: 6601 - DNA, 13 bp, Artificial Sequence
  synthetic sequence
cggcttggcaacc

SEQ ID NO: 6602 - DNA, 13 bp, Artificial Sequence
  synthetic sequence
ctaatccgacgta

SEQ ID NO: 6603 - DNA, 13 bp, Artificial Sequence
  synthetic sequence
cgcctcagtgtca

SEQ ID NO: 6604 - DNA, 13 bp, Artificial Sequence
  synthetic sequence
ttatcaccggcag

SEQ ID NO: 6605 - DNA, 13 bp, Artificial Sequence
  synthetic sequence
tcccgtaggagtc

SEQ ID NO: 6606 - DNA, 13 bp, Artificial Sequence
  synthetic sequence
tactaagaagtga

SEQ ID NO: 6607 - DNA, 13 bp, Artificial Sequence
  synthetic sequence
gcttgcactctct

SEQ ID NO: 6608 - DNA, 13 bp, Artificial Sequence
  synthetic sequence
tgacgacagccat

SEQ ID NO: 6609 - DNA, 13 bp, Artificial Sequence
  synthetic sequence
gggtgagtaacgc

SEQ ID NO: 6610 - DNA, 13 bp, Artificial Sequence
  synthetic sequence
gaaggaacaccaa

SEQ ID NO: 6611 - DNA, 13 bp, Artificial Sequence
  synthetic sequence
atgtgaaagccca

SEQ ID NO: 6612 - DNA, 13 bp, Artificial Sequence
  synthetic sequence
gttaagtcccgca

SEQ ID NO: 6613 - DNA, 13 bp, Artificial Sequence
  synthetic sequence
agtactagctgtt

SEQ ID NO: 6614 - DNA, 13 bp, Artificial Sequence
  synthetic sequence
gggctacacacgt

SEQ ID NO: 6615 - DNA, 13 bp, Artificial Sequence
  synthetic sequence
gccagcagccgcg

SEQ ID NO: 6616 - DNA, 13 bp, Artificial Sequence
  synthetic sequence
tgatccagcaatg

SEQ ID NO: 6617 - DNA, 13 bp, Artificial Sequence
  synthetic sequence
ctgatttgagagg

SEQ ID NO: 6618 - DNA, 13 bp, Artificial Sequence
  synthetic sequence
attgacggggacc

SEQ ID NO: 6619 - DNA, 13 bp, Artificial Sequence
  synthetic sequence
tttctagagatag

SEQ ID NO: 6620 - DNA, 13 bp, Artificial Sequence
  synthetic sequence
gcagatggatgag

SEQ ID NO: 6621 - DNA, 13 bp, Artificial Sequence
  synthetic sequence
gtattctgacctg

SEQ ID NO: 6622 - DNA, 13 bp, Artificial Sequence
  synthetic sequence
ctgtaatacccat

SEQ ID NO: 6623 - DNA, 13 bp, Artificial Sequence
  synthetic sequence
ccgccttgtcagc

SEQ ID NO: 6624 - DNA, 13 bp, Artificial Sequence
  synthetic sequence
gatccccacgctt

SEQ ID NO: 6625 - DNA, 13 bp, Artificial Sequence
  synthetic sequence
caccaactagcta

SEQ ID NO: 6626 - DNA, 13 bp, Artificial Sequence
  synthetic sequence
cccactgctgcct

SEQ ID NO: 6627 - DNA, 13 bp, Artificial Sequence
  synthetic sequence
ctccccaactaaa

SEQ ID NO: 6628 - DNA, 13 bp, Artificial Sequence
  synthetic sequence
attaaaccacatg

SEQ ID NO: 6629 - DNA, 13 bp, Artificial Sequence
  synthetic sequence
cagccgtgcagca

SEQ ID NO: 6630 - DNA, 13 bp, Artificial Sequence
  synthetic sequence
gcccagtaattcc

SEQ ID NO: 6631 - DNA, 13 bp, Artificial Sequence
  synthetic sequence
gctgcgccactag

SEQ ID NO: 6632 - DNA, 13 bp, Artificial Sequence
  synthetic sequence
ccatactctagtt

SEQ ID NO: 6633 - DNA, 13 bp, Artificial Sequence
  synthetic sequence
ttcctctaccgta

SEQ ID NO: 6634 - DNA, 13 bp, Artificial Sequence
  synthetic sequence
tacttatcgcgtt

SEQ ID NO: 6635 - DNA, 13 bp, Artificial Sequence
  synthetic sequence
acgggtgagtaac

SEQ ID NO: 6636 - DNA, 13 bp, Artificial Sequence
  synthetic sequence
ctagtgtagaggt

SEQ ID NO: 6637 - DNA, 13 bp, Artificial Sequence
  synthetic sequence
caaacaggattag

SEQ ID NO: 6638 - DNA, 13 bp, Artificial Sequence
  synthetic sequence
ttcggaattactg

SEQ ID NO: 6639 - DNA, 13 bp, Artificial Sequence
  synthetic sequence
ttaagcactccgc

SEQ ID NO: 6640 - DNA, 13 bp, Artificial Sequence
  synthetic sequence
agctcgtgtcgtg

SEQ ID NO: 6641 - DNA, 13 bp, Artificial Sequence
  synthetic sequence
ggtttaattcgat

SEQ ID NO: 6642 - DNA, 13 bp, Artificial Sequence
  synthetic sequence
actataagaaaac

SEQ ID NO: 6643 - DNA, 13 bp, Artificial Sequence
  synthetic sequence
gagacacggccca

SEQ ID NO: 6644 - DNA, 13 bp, Artificial Sequence
  synthetic sequence
cagattaggtagt

SEQ ID NO: 6645 - DNA, 13 bp, Artificial Sequence
  synthetic sequence
gtggagcaaatcc

SEQ ID NO: 6646 - DNA, 13 bp, Artificial Sequence
  synthetic sequence
ggttgtaaagctc

SEQ ID NO: 6647 - DNA, 13 bp, Artificial Sequence
  synthetic sequence
gttgtaaaactct

SEQ ID NO: 6648 - DNA, 13 bp, Artificial Sequence
  synthetic sequence
ctctaaaagacat

SEQ ID NO: 6649 - DNA, 13 bp, Artificial Sequence
  synthetic sequence
gtcgttggtgagg

SEQ ID NO: 6650 - DNA, 13 bp, Artificial Sequence
  synthetic sequence
gcgattccaactt

SEQ ID NO: 6651 - DNA, 13 bp, Artificial Sequence
  synthetic sequence
cccagtgtggctg

SEQ ID NO: 6652 - DNA, 13 bp, Artificial Sequence
  synthetic sequence
gcacggagttagc

SEQ ID NO: 6653 - DNA, 13 bp, Artificial Sequence
  synthetic sequence
cattgtagcacgc

SEQ ID NO: 6654 - DNA, 13 bp, Artificial Sequence
  synthetic sequence
ctggatcaggctt

SEQ ID NO: 6655 - DNA, 13 bp, Artificial Sequence
  synthetic sequence
tggcaaataagaa

SEQ ID NO: 6656 - DNA, 13 bp, Artificial Sequence
  synthetic sequence
tgagttttaatct

SEQ ID NO: 6657 - DNA, 13 bp, Artificial Sequence
  synthetic sequence
cactcatcgttta

SEQ ID NO: 6658 - DNA, 13 bp, Artificial Sequence
  synthetic sequence
tgttcctcctaat

SEQ ID NO: 6659 - DNA, 13 bp, Artificial Sequence
  synthetic sequence
aaagcatctctgc

SEQ ID NO: 6660 - DNA, 13 bp, Artificial Sequence
  synthetic sequence
tttgaaagcaatt

SEQ ID NO: 6661 - DNA, 13 bp, Artificial Sequence
  synthetic sequence
gcgattccggctt

SEQ ID NO: 6662 - DNA, 13 bp, Artificial Sequence
  synthetic sequence
cagttttagaagc

SEQ ID NO: 6663 - DNA, 13 bp, Artificial Sequence
  synthetic sequence
ggtccagccgagc

SEQ ID NO: 6664 - DNA, 13 bp, Artificial Sequence
  synthetic sequence
gtgttcttcctaa

SEQ ID NO: 6665 - DNA, 13 bp, Artificial Sequence
  synthetic sequence
cgggctttcactt

SEQ ID NO: 6666 - DNA, 13 bp, Artificial Sequence
  synthetic sequence
gatggatgccttg

SEQ ID NO: 6667 - DNA, 13 bp, Artificial Sequence
  synthetic sequence
agctggttctccg

SEQ ID NO: 6668 - DNA, 13 bp, Artificial Sequence
  synthetic sequence
cggataaaaggta

SEQ ID NO: 6669 - DNA, 13 bp, Artificial Sequence
  synthetic sequence
ctgaaccttttaa

SEQ ID NO: 6670 - DNA, 13 bp, Artificial Sequence
  synthetic sequence
ccgtaaaactgac

SEQ ID NO: 6671 - DNA, 13 bp, Artificial Sequence
  synthetic sequence
atgcggggtaccc

SEQ ID NO: 6672 - DNA, 13 bp, Artificial Sequence
  synthetic sequence
ctgtaacttaggg

SEQ ID NO: 6673 - DNA, 13 bp, Artificial Sequence
  synthetic sequence
cctgcccggtgct

SEQ ID NO: 6674 - DNA, 13 bp, Artificial Sequence
  synthetic sequence
aatttgagaggat

SEQ ID NO: 6675 - DNA, 13 bp, Artificial Sequence
  synthetic sequence
tagtgacgagcga

SEQ ID NO: 6676 - DNA, 13 bp, Artificial Sequence
  synthetic sequence
atgtcgactcatc

SEQ ID NO: 6677 - DNA, 13 bp, Artificial Sequence
  synthetic sequence
acaagtaccgtga

SEQ ID NO: 6678 - DNA, 13 bp, Artificial Sequence
  synthetic sequence
acattgtatggtg

SEQ ID NO: 6679 - DNA, 13 bp, Artificial Sequence
  synthetic sequence
aaactccgaatac

SEQ ID NO: 6680 - DNA, 13 bp, Artificial Sequence
  synthetic sequence
ttcctgtgttaag

SEQ ID NO: 6681 - DNA, 13 bp, Artificial Sequence
  synthetic sequence
ttcttgcgccgaa

SEQ ID NO: 6682 - DNA, 13 bp, Artificial Sequence
  synthetic sequence
aaaccgacactgg

SEQ ID NO: 6683 - DNA, 13 bp, Artificial Sequence
  synthetic sequence
ccgtctaaggtcc

SEQ ID NO: 6684 - DNA, 13 bp, Artificial Sequence
  synthetic sequence
ggaggaccgaacc

SEQ ID NO: 6685 - DNA, 13 bp, Artificial Sequence
  synthetic sequence
gaatggggaaacc

SEQ ID NO: 6686 - DNA, 13 bp, Artificial Sequence
  synthetic sequence
tcagcttttatag

SEQ ID NO: 6687 - DNA, 13 bp, Artificial Sequence
  synthetic sequence
gtagcggagcgtt

SEQ ID NO: 6688 - DNA, 13 bp, Artificial Sequence
  synthetic sequence
agcttaagccgtt

SEQ ID NO: 6689 - DNA, 13 bp, Artificial Sequence
  synthetic sequence
agatccttgagta

SEQ ID NO: 6690 - DNA, 13 bp, Artificial Sequence
  synthetic sequence
gtgccaacagcat

SEQ ID NO: 6691 - DNA, 13 bp, Artificial Sequence
  synthetic sequence
ggaaactttgaag

SEQ ID NO: 6692 - DNA, 13 bp, Artificial Sequence
  synthetic sequence
agttggagcctta

SEQ ID NO: 6693 - DNA, 13 bp, Artificial Sequence
  synthetic sequence
gggagactttgaa

SEQ ID NO: 6694 - DNA, 13 bp, Artificial Sequence
  synthetic sequence
acgggataattgc

SEQ ID NO: 6695 - DNA, 13 bp, Artificial Sequence
  synthetic sequence
agttggagcttat

SEQ ID NO: 6696 - DNA, 13 bp, Artificial Sequence
  synthetic sequence
cagttggagcttg

SEQ ID NO: 6697 - DNA, 13 bp, Artificial Sequence
  synthetic sequence
gatggtgatagcc

SEQ ID NO: 6698 - DNA, 13 bp, Artificial Sequence
  synthetic sequence
agcaagcttaagc

SEQ ID NO: 6699 - DNA, 13 bp, Artificial Sequence
  synthetic sequence
gggctattagtac

SEQ ID NO: 6700 - DNA, 13 bp, Artificial Sequence
  synthetic sequence
tcgggtctaatcc

SEQ ID NO: 6701 - DNA, 13 bp, Artificial Sequence
  synthetic sequence
ctcacgacgttct

SEQ ID NO: 6702 - DNA, 13 bp, Artificial Sequence
  synthetic sequence
tcaatcgccttag

SEQ ID NO: 6703 - DNA, 13 bp, Artificial Sequence
  synthetic sequence
gcacgcctccgtt

SEQ ID NO: 6704 - DNA, 13 bp, Artificial Sequence
  synthetic sequence
gatacctccagca

SEQ ID NO: 6705 - DNA, 13 bp, Artificial Sequence
  synthetic sequence
aggatggctgctt

SEQ ID NO: 6706 - DNA, 13 bp, Artificial Sequence
  synthetic sequence
ctggtacaccaga

SEQ ID NO: 6707 - DNA, 13 bp, Artificial Sequence
  synthetic sequence
aaaaggtacgctg

SEQ ID NO: 6708 - DNA, 13 bp, Artificial Sequence
  synthetic sequence
cgatatgaactct

SEQ ID NO: 6709 - DNA, 13 bp, Artificial Sequence
  synthetic sequence
ggcctttcacccc

SEQ ID NO: 6710 - DNA, 13 bp, Artificial Sequence
  synthetic sequence
ctgtgtttttagt

SEQ ID NO: 6711 - DNA, 13 bp, Artificial Sequence
  synthetic sequence
tcagtgctctacc

SEQ ID NO: 6712 - DNA, 13 bp, Artificial Sequence
  synthetic sequence
tatgaccgacttt

SEQ ID NO: 6713 - DNA, 13 bp, Artificial Sequence
  synthetic sequence
cgttacgccattc

SEQ ID NO: 6714 - DNA, 13 bp, Artificial Sequence
  synthetic sequence
agatatttcagtt

SEQ ID NO: 6715 - DNA, 13 bp, Artificial Sequence
  synthetic sequence
tccgactaaccct

SEQ ID NO: 6716 - DNA, 13 bp, Artificial Sequence
  synthetic sequence
ccacggacttagc

SEQ ID NO: 6717 - DNA, 13 bp, Artificial Sequence
  synthetic sequence
aatgtaaagctat

SEQ ID NO: 6718 - DNA, 13 bp, Artificial Sequence
  synthetic sequence
tctatttcactcc

SEQ ID NO: 6719 - DNA, 13 bp, Artificial Sequence
  synthetic sequence
ttactggggcttc

SEQ ID NO: 6720 - DNA, 13 bp, Artificial Sequence
  synthetic sequence
atggggaaatcta

SEQ ID NO: 6721 - DNA, 13 bp, Artificial Sequence
  synthetic sequence
aggatggtccccc

SEQ ID NO: 6722 - DNA, 13 bp, Artificial Sequence
  synthetic sequence
gtggtatctcaag

SEQ ID NO: 6723 - DNA, 13 bp, Artificial Sequence
  synthetic sequence
caatccaataagg

SEQ ID NO: 6724 - DNA, 13 bp, Artificial Sequence
  synthetic sequence
gcttgagccccgt

SEQ ID NO: 6725 - DNA, 13 bp, Artificial Sequence
  synthetic sequence
agtattctaattt

SEQ ID NO: 6726 - DNA, 13 bp, Artificial Sequence
  synthetic sequence
ctttagccccgtt

SEQ ID NO: 6727 - DNA, 13 bp, Artificial Sequence
  synthetic sequence
cattccagtttct

SEQ ID NO: 6728 - DNA, 13 bp, Artificial Sequence
  synthetic sequence
ttaaggcatgcgt

SEQ ID NO: 6729 - DNA, 13 bp, Artificial Sequence
  synthetic sequence
ctctttaaagcac

SEQ ID NO: 6730 - DNA, 13 bp, Artificial Sequence
  synthetic sequence
aatgtaaagagtg

SEQ ID NO: 6731 - DNA, 13 bp, Artificial Sequence
  synthetic sequence
gtggatgccttgg

SEQ ID NO: 6732 - DNA, 13 bp, Artificial Sequence
  synthetic sequence
gaaatcctgtctg

SEQ ID NO: 6733 - DNA, 13 bp, Artificial Sequence
  synthetic sequence
tgagaatgctgac

SEQ ID NO: 6734 - DNA, 13 bp, Artificial Sequence
  synthetic sequence
catttaaagaaag

SEQ ID NO: 6735 - DNA, 13 bp, Artificial Sequence
  synthetic sequence
agacggtcatagt

SEQ ID NO: 6736 - DNA, 13 bp, Artificial Sequence
  synthetic sequence
ctccagggggtag

SEQ ID NO: 6737 - DNA, 13 bp, Artificial Sequence
  synthetic sequence
ctccaacgtagac

SEQ ID NO: 6738 - DNA, 13 bp, Artificial Sequence
  synthetic sequence
ggtgaaaggccaa

SEQ ID NO: 6739 - DNA, 13 bp, Artificial Sequence
  synthetic sequence
aaatagctcccac

SEQ ID NO: 6740 - DNA, 13 bp, Artificial Sequence
  synthetic sequence
cgacggggttgtt

SEQ ID NO: 6741 - DNA, 13 bp, Artificial Sequence
  synthetic sequence
gccgaaaggcgta

SEQ ID NO: 6742 - DNA, 13 bp, Artificial Sequence
  synthetic sequence
aaacacagggctc

SEQ ID NO: 6743 - DNA, 13 bp, Artificial Sequence
  synthetic sequence
ggattagacccga

SEQ ID NO: 6744 - DNA, 13 bp, Artificial Sequence
  synthetic sequence
ttgagagaactac

SEQ ID NO: 6745 - DNA, 13 bp, Artificial Sequence
  synthetic sequence
gtaccttttgtat

SEQ ID NO: 6746 - DNA, 13 bp, Artificial Sequence
  synthetic sequence
cgaatggggcaac

SEQ ID NO: 6747 - DNA, 13 bp, Artificial Sequence
  synthetic sequence
gggaaaggtgaaa

SEQ ID NO: 6748 - DNA, 13 bp, Artificial Sequence
  synthetic sequence
attgaagccccag

SEQ ID NO: 6749 - DNA, 13 bp, Artificial Sequence
  synthetic sequence
aacgtccgtcgtg

SEQ ID NO: 6750 - DNA, 13 bp, Artificial Sequence
  synthetic sequence
tttacactggcat

SEQ ID NO: 6751 - DNA, 13 bp, Artificial Sequence
  synthetic sequence
agtggcgagcgaa

SEQ ID NO: 6752 - DNA, 13 bp, Artificial Sequence
  synthetic sequence
ccatacaccgaag

SEQ ID NO: 6753 - DNA, 13 bp, Artificial Sequence
  synthetic sequence
aacggtcggaaat

SEQ ID NO: 6754 - DNA, 13 bp, Artificial Sequence
  synthetic sequence
aacgcagggaact

SEQ ID NO: 6755 - DNA, 13 bp, Artificial Sequence
  synthetic sequence
aataccaccctta

SEQ ID NO: 6756 - DNA, 13 bp, Artificial Sequence
  synthetic sequence
gatagggaccgaa

SEQ ID NO: 6757 - DNA, 13 bp, Artificial Sequence
  synthetic sequence
aagcaggaaccct

SEQ ID NO: 6758 - DNA, 13 bp, Artificial Sequence
  synthetic sequence
tgtttgtaggcat

SEQ ID NO: 6759 - DNA, 13 bp, Artificial Sequence
  synthetic sequence
gtcacgcttcttc

SEQ ID NO: 6760 - DNA, 13 bp, Artificial Sequence
  synthetic sequence
gccatacccttgg

SEQ ID NO: 6761 - DNA, 13 bp, Artificial Sequence
  synthetic sequence
taaccttccagca

SEQ ID NO: 6762 - DNA, 13 bp, Artificial Sequence
  synthetic sequence
cgttacattttcg

SEQ ID NO: 6763 - DNA, 13 bp, Artificial Sequence
  synthetic sequence
cgtgcaggtcgga

SEQ ID NO: 6764 - DNA, 13 bp, Artificial Sequence
  synthetic sequence
acaggtccacgaa

SEQ ID NO: 6765 - DNA, 13 bp, Artificial Sequence
  synthetic sequence
ttttatccgttga

SEQ ID NO: 6766 - DNA, 13 bp, Artificial Sequence
  synthetic sequence
agatttcgcggag

SEQ ID NO: 6767 - DNA, 13 bp, Artificial Sequence
  synthetic sequence
ctttcgctacgcc

SEQ ID NO: 6768 - DNA, 13 bp, Artificial Sequence
  synthetic sequence
cctgtgtcggttt

SEQ ID NO: 6769 - DNA, 13 bp, Artificial Sequence
  synthetic sequence
ttatgccattgca

SEQ ID NO: 6770 - DNA, 13 bp, Artificial Sequence
  synthetic sequence
caggtacttagat

SEQ ID NO: 6771 - DNA, 13 bp, Artificial Sequence
  synthetic sequence
atgcacgagtact

SEQ ID NO: 6772 - DNA, 13 bp, Artificial Sequence
  synthetic sequence
tcttccaggtatt

SEQ ID NO: 6773 - DNA, 13 bp, Artificial Sequence
  synthetic sequence
cagtaagtgttac

SEQ ID NO: 6774 - DNA, 13 bp, Artificial Sequence
  synthetic sequence
cataacttgggga

SEQ ID NO: 6775 - DNA, 13 bp, Artificial Sequence
  synthetic sequence
accgccccagtca

SEQ ID NO: 6776 - DNA, 13 bp, Artificial Sequence
  synthetic sequence
ttacggaacgctc

SEQ ID NO: 6777 - DNA, 13 bp, Artificial Sequence
  synthetic sequence
ccgcatcttcacg

SEQ ID NO: 6778 - DNA, 13 bp, Artificial Sequence
  synthetic sequence
caaggatgactcc

SEQ ID NO: 6779 - DNA, 13 bp, Artificial Sequence
  synthetic sequence
acgggactatcac

SEQ ID NO: 6780 - DNA, 13 bp, Artificial Sequence
  synthetic sequence
ctaaactgtcttt

SEQ ID NO: 6781 - DNA, 13 bp, Artificial Sequence
  synthetic sequence
aaacagcttaatt

SEQ ID NO: 6782 - DNA, 13 bp, Artificial Sequence
  synthetic sequence
ctagaaacctaaa

SEQ ID NO: 6783 - DNA, 13 bp, Artificial Sequence
  synthetic sequence
gtcgagctttcca

SEQ ID NO: 6784 - DNA, 13 bp, Artificial Sequence
  synthetic sequence
aattagtattagt

SEQ ID NO: 6785 - DNA, 13 bp, Artificial Sequence
  synthetic sequence
tactcgaccagtg

SEQ ID NO: 6786 - DNA, 13 bp, Artificial Sequence
  synthetic sequence
tctcaaatatcca

SEQ ID NO: 6787 - DNA, 13 bp, Artificial Sequence
  synthetic sequence
ggcaggtgtcagt

SEQ ID NO: 6788 - DNA, 13 bp, Artificial Sequence
  synthetic sequence
aggctgaacttaa

SEQ ID NO: 6789 - DNA, 13 bp, Artificial Sequence
  synthetic sequence
cttttccacttaa

SEQ ID NO: 6790 - DNA, 13 bp, Artificial Sequence
  synthetic sequence
ttatccccggagt

SEQ ID NO: 6791 - DNA, 13 bp, Artificial Sequence
  synthetic sequence
gctaccttaggac

SEQ ID NO: 6792 - DNA, 13 bp, Artificial Sequence
  synthetic sequence
ccgtctaaccaca

SEQ ID NO: 6793 - DNA, 13 bp, Artificial Sequence
  synthetic sequence
tcgacttgtcagt

SEQ ID NO: 6794 - DNA, 13 bp, Artificial Sequence
  synthetic sequence
gtcggtttgcggt

SEQ ID NO: 6795 - DNA, 13 bp, Artificial Sequence
  synthetic sequence
cttcccacttaga

SEQ ID NO: 6796 - DNA, 13 bp, Artificial Sequence
  synthetic sequence
ttaagactcgctt

SEQ ID NO: 6797 - DNA, 13 bp, Artificial Sequence
  synthetic sequence
atagcattcggag

SEQ ID NO: 6798 - DNA, 13 bp, Artificial Sequence
  synthetic sequence
ttctgatacctcc

SEQ ID NO: 6799 - DNA, 13 bp, Artificial Sequence
  synthetic sequence
ctctttaggaggc

SEQ ID NO: 6800 - DNA, 13 bp, Artificial Sequence
  synthetic sequence
aggaaaccttagg

SEQ ID NO: 6801 - DNA, 13 bp, Artificial Sequence
  synthetic sequence
aatgtttgcttct

SEQ ID NO: 6802 - DNA, 13 bp, Artificial Sequence
  synthetic sequence
taggacctgctcc

SEQ ID NO: 6803 - DNA, 13 bp, Artificial Sequence
  synthetic sequence
gtctcccacctat

SEQ ID NO: 6804 - DNA, 13 bp, Artificial Sequence
  synthetic sequence
agagtggtctccc

SEQ ID NO: 6805 - DNA, 13 bp, Artificial Sequence
  synthetic sequence
ttcggccctccac

SEQ ID NO: 6806 - DNA, 13 bp, Artificial Sequence
  synthetic sequence
gaaactataagag

SEQ ID NO: 6807 - DNA, 13 bp, Artificial Sequence
  synthetic sequence
tgactgcttgtaa

SEQ ID NO: 6808 - DNA, 13 bp, Artificial Sequence
  synthetic sequence
ttcctcagggtac

SEQ ID NO: 6809 - DNA, 13 bp, Artificial Sequence
  synthetic sequence
gaccatttttatg

SEQ ID NO: 6810 - DNA, 13 bp, Artificial Sequence
  synthetic sequence
cgtcctacaaccc

SEQ ID NO: 6811 - DNA, 13 bp, Artificial Sequence
  synthetic sequence
actcatcatcaca

SEQ ID NO: 6812 - DNA, 13 bp, Artificial Sequence
  synthetic sequence
tcatcatcatatc

SEQ ID NO: 6813 - DNA, 13 bp, Artificial Sequence
  synthetic sequence
accctctaaatgc

SEQ ID NO: 6814 - DNA, 13 bp, Artificial Sequence
  synthetic sequence
gagctttaaggcg

SEQ ID NO: 6815 - DNA, 13 bp, Artificial Sequence
  synthetic sequence
ggtctctgcaaat

SEQ ID NO: 6816 - DNA, 13 bp, Artificial Sequence
  synthetic sequence
tacctttaaagag

SEQ ID NO: 6817 - DNA, 13 bp, Artificial Sequence
  synthetic sequence
ggaactctgcaaa

SEQ ID NO: 6818 - DNA, 13 bp, Artificial Sequence
  synthetic sequence
acaacccagacca

SEQ ID NO: 6819 - DNA, 13 bp, Artificial Sequence
  synthetic sequence
ggcgtgccttttg

SEQ ID NO: 6820 - DNA, 13 bp, Artificial Sequence
  synthetic sequence
aagcgccgtcact

SEQ ID NO: 6821 - DNA, 13 bp, Artificial Sequence
  synthetic sequence
atttggacgctgt

SEQ ID NO: 6822 - DNA, 13 bp, Artificial Sequence
  synthetic sequence
ttctaaggttagg

SEQ ID NO: 6823 - DNA, 13 bp, Artificial Sequence
  synthetic sequence
ttctaaggttagg

SEQ ID NO: 6824 - DNA, 13 bp, Artificial Sequence
  synthetic sequence
gaaacgggttaat

SEQ ID NO: 6825 - DNA, 13 bp, Artificial Sequence
  synthetic sequence
ctcgatgtcggct

SEQ ID NO: 6826 - DNA, 13 bp, Artificial Sequence
  synthetic sequence
atgagctgtgaat

SEQ ID NO: 6827 - DNA, 13 bp, Artificial Sequence
  synthetic sequence
ggaggtgcgcaaa

SEQ ID NO: 6828 - DNA, 13 bp, Artificial Sequence
  synthetic sequence
agtaaacggcggc

SEQ ID NO: 6829 - DNA, 13 bp, Artificial Sequence
  synthetic sequence
tcagaacgtcgtg

SEQ ID NO: 6830 - DNA, 13 bp, Artificial Sequence
  synthetic sequence
gaaataccaccct

SEQ ID NO: 6831 - DNA, 13 bp, Artificial Sequence
  synthetic sequence
taccgaagctttg

SEQ ID NO: 6832 - DNA, 13 bp, Artificial Sequence
  synthetic sequence
ccgagtgatctat

SEQ ID NO: 6833 - DNA, 13 bp, Artificial Sequence
  synthetic sequence
gccaagggtaagt

SEQ ID NO: 6834 - DNA, 13 bp, Artificial Sequence
  synthetic sequence
gctagggcctgtc

SEQ ID NO: 6835 - DNA, 13 bp, Artificial Sequence
  synthetic sequence
atatagaagaata

SEQ ID NO: 6836 - DNA, 13 bp, Artificial Sequence
  synthetic sequence
gtcctagtttaag

SEQ ID NO: 6837 - DNA, 13 bp, Artificial Sequence
  synthetic sequence
tgaacctttacta

SEQ ID NO: 6838 - DNA, 13 bp, Artificial Sequence
  synthetic sequence
agtggcgagcgaa

SEQ ID NO: 6839 - DNA, 13 bp, Artificial Sequence
  synthetic sequence
cacgagaaacctt

SEQ ID NO: 6840 - DNA, 13 bp, Artificial Sequence
  synthetic sequence
taatagaggcgat

SEQ ID NO: 6841 - DNA, 13 bp, Artificial Sequence
  synthetic sequence
tagatgctaatta

SEQ ID NO: 6842 - DNA, 13 bp, Artificial Sequence
  synthetic sequence
gagaaaccctgtc

SEQ ID NO: 6843 - DNA, 13 bp, Artificial Sequence
  synthetic sequence
tattgagatttga

SEQ ID NO: 6844 - DNA, 13 bp, Artificial Sequence
  synthetic sequence
ttagcctaaactt

SEQ ID NO: 6845 - DNA, 13 bp, Artificial Sequence
  synthetic sequence
aggggagtagccc

SEQ ID NO: 6846 - DNA, 13 bp, Artificial Sequence
  synthetic sequence
tgattttagtagg

SEQ ID NO: 6847 - DNA, 13 bp, Artificial Sequence
  synthetic sequence
gccttggcatgca

SEQ ID NO: 6848 - DNA, 13 bp, Artificial Sequence
  synthetic sequence
gcgaacgcggacc

SEQ ID NO: 6849 - DNA, 13 bp, Artificial Sequence
  synthetic sequence
ggttccaggaaat

SEQ ID NO: 6850 - DNA, 13 bp, Artificial Sequence
  synthetic sequence
aaataaggtatct

SEQ ID NO: 6851 - DNA, 13 bp, Artificial Sequence
  synthetic sequence
ataaagggagtga

SEQ ID NO: 6852 - DNA, 13 bp, Artificial Sequence
  synthetic sequence
actggcattcgtg

SEQ ID NO: 6853 - DNA, 13 bp, Artificial Sequence
  synthetic sequence
cgaaccagtaccg

SEQ ID NO: 6854 - DNA, 13 bp, Artificial Sequence
  synthetic sequence
gaatacccccggg

SEQ ID NO: 6855 - DNA, 13 bp, Artificial Sequence
  synthetic sequence
tccctatcagagc

SEQ ID NO: 6856 - DNA, 13 bp, Artificial Sequence
  synthetic sequence
ggacgtatctctg

SEQ ID NO: 6857 - DNA, 13 bp, Artificial Sequence
  synthetic sequence
tgacttgtggcta

SEQ ID NO: 6858 - DNA, 13 bp, Artificial Sequence
  synthetic sequence
aagccccagtaaa

SEQ ID NO: 6859 - DNA, 13 bp, Artificial Sequence
  synthetic sequence
gtataatgggtca

SEQ ID NO: 6860 - DNA, 13 bp, Artificial Sequence
  synthetic sequence
gcaacccacctta

SEQ ID NO: 6861 - DNA, 13 bp, Artificial Sequence
  synthetic sequence
tggtcccgcgtgg

SEQ ID NO: 6862 - DNA, 13 bp, Artificial Sequence
  synthetic sequence
ggcacctcgatgt

SEQ ID NO: 6863 - DNA, 13 bp, Artificial Sequence
  synthetic sequence
cgatgcattagac

SEQ ID NO: 6864 - DNA, 13 bp, Artificial Sequence
  synthetic sequence
tcagaacggtcgg

SEQ ID NO: 6865 - DNA, 13 bp, Artificial Sequence
  synthetic sequence
acgtatgtgcgtg

SEQ ID NO: 6866 - DNA, 13 bp, Artificial Sequence
  synthetic sequence
cgggtgctaacgt

SEQ ID NO: 6867 - DNA, 13 bp, Artificial Sequence
  synthetic sequence
cggcaaaatgcac

SEQ ID NO: 6868 - DNA, 13 bp, Artificial Sequence
  synthetic sequence
aactgcggcccgt

SEQ ID NO: 6869 - DNA, 13 bp, Artificial Sequence
  synthetic sequence
cagactcagtgaa

SEQ ID NO: 6870 - DNA, 13 bp, Artificial Sequence
  synthetic sequence
agtagggcgggac

SEQ ID NO: 6871 - DNA, 13 bp, Artificial Sequence
  synthetic sequence
cccatgtgggccg

SEQ ID NO: 6872 - DNA, 13 bp, Artificial Sequence
  synthetic sequence
tttaaagaaagcg

SEQ ID NO: 6873 - DNA, 13 bp, Artificial Sequence
  synthetic sequence
cgtcgtgagacag

SEQ ID NO: 6874 - DNA, 13 bp, Artificial Sequence
  synthetic sequence
tttaccaaaaaca

SEQ ID NO: 6875 - DNA, 13 bp, Artificial Sequence
  synthetic sequence
gtcgatgggaacc

SEQ ID NO: 6876 - DNA, 13 bp, Artificial Sequence
  synthetic sequence
attagtaccggta

SEQ ID NO: 6877 - DNA, 13 bp, Artificial Sequence
  synthetic sequence
tagaaagctgtgc

SEQ ID NO: 6878 - DNA, 13 bp, Artificial Sequence
  synthetic sequence
gtaccttttatcc

SEQ ID NO: 6879 - DNA, 13 bp, Artificial Sequence
  synthetic sequence
caggaacccttgg

SEQ ID NO: 6880 - DNA, 13 bp, Artificial Sequence
  synthetic sequence
accgtaccttcaa

SEQ ID NO: 6881 - DNA, 13 bp, Artificial Sequence
  synthetic sequence
cgtactagggaca

SEQ ID NO: 6882 - DNA, 13 bp, Artificial Sequence
  synthetic sequence
ccccggtacattt

SEQ ID NO: 6883 - DNA, 13 bp, Artificial Sequence
  synthetic sequence
ttgggacctgctc

SEQ ID NO: 6884 - DNA, 13 bp, Artificial Sequence
  synthetic sequence
aaggctggcgccc

SEQ ID NO: 6885 - DNA, 13 bp, Artificial Sequence
  synthetic sequence
acaggcttacgga

SEQ ID NO: 6886 - DNA, 13 bp, Artificial Sequence
  synthetic sequence
ttcgctgcgccta

SEQ ID NO: 6887 - DNA, 13 bp, Artificial Sequence
  synthetic sequence
acgggactatcac

SEQ ID NO: 6888 - DNA, 13 bp, Artificial Sequence
  synthetic sequence
acaaggaatttcg

SEQ ID NO: 6889 - DNA, 13 bp, Artificial Sequence
  synthetic sequence
cagaccctatacg

SEQ ID NO: 6890 - DNA, 13 bp, Artificial Sequence
  synthetic sequence
ttgctccaacaaa

SEQ ID NO: 6891 - DNA, 13 bp, Artificial Sequence
  synthetic sequence
cggtttagggtac

SEQ ID NO: 6892 - DNA, 13 bp, Artificial Sequence
  synthetic sequence
ggttgcccatagt

SEQ ID NO: 6893 - DNA, 13 bp, Artificial Sequence
  synthetic sequence
tgggctccaactg

SEQ ID NO: 6894 - DNA, 13 bp, Artificial Sequence
  synthetic sequence
cagtcttgcagtc

SEQ ID NO: 6895 - DNA, 13 bp, Artificial Sequence
  synthetic sequence
gtggtcgacccat

SEQ ID NO: 6896 - DNA, 13 bp, Artificial Sequence
  synthetic sequence
gaaccagctatct

SEQ ID NO: 6897 - DNA, 13 bp, Artificial Sequence
  synthetic sequence
cttcagcggttat

SEQ ID NO: 6898 - DNA, 13 bp, Artificial Sequence
  synthetic sequence
cccacttagccat

SEQ ID NO: 6899 - DNA, 13 bp, Artificial Sequence
  synthetic sequence
ggtattcggagtt

SEQ ID NO: 6900 - DNA, 13 bp, Artificial Sequence
  synthetic sequence
aggcccacgaata

SEQ ID NO: 6901 - DNA, 13 bp, Artificial Sequence
  synthetic sequence
tcaaactacccac

SEQ ID NO: 6902 - DNA, 13 bp, Artificial Sequence
  synthetic sequence
aaccccgcatctt

SEQ ID NO: 6903 - DNA, 13 bp, Artificial Sequence
  synthetic sequence
agtctcgtttgat

SEQ ID NO: 6904 - DNA, 13 bp, Artificial Sequence
  synthetic sequence
aggtatccgaatg

SEQ ID NO: 6905 - DNA, 13 bp, Artificial Sequence
  synthetic sequence
agcttcgttgtcg

SEQ ID NO: 6906 - DNA, 13 bp, Artificial Sequence
  synthetic sequence
tgtcgggtaagtt

SEQ ID NO: 6907 - DNA, 13 bp, Artificial Sequence
  synthetic sequence
caatgccaaaagg

SEQ ID NO: 6908 - DNA, 13 bp, Artificial Sequence
  synthetic sequence
gttgaaaaaggtt

SEQ ID NO: 6909 - DNA, 13 bp, Artificial Sequence
  synthetic sequence
ggcgtgccttttg

SEQ ID NO: 6910 - DNA, 13 bp, Artificial Sequence
  synthetic sequence
taggttgactgca

SEQ ID NO: 6911 - DNA, 13 bp, Artificial Sequence
  synthetic sequence
aagcacgcggacg

SEQ ID NO: 6912 - DNA, 13 bp, Artificial Sequence
  synthetic sequence
agaccccgtgaac

SEQ ID NO: 6913 - DNA, 13 bp, Artificial Sequence
  synthetic sequence
cctcggataataa

SEQ ID NO: 6914 - DNA, 13 bp, Artificial Sequence
  synthetic sequence
gccaccaagagtt

SEQ ID NO: 6915 - DNA, 13 bp, Artificial Sequence
  synthetic sequence
tactgtgaaggaa

SEQ ID NO: 6916 - DNA, 13 bp, Artificial Sequence
  synthetic sequence
tggcttagaggca

SEQ ID NO: 6917 - DNA, 13 bp, Artificial Sequence
  synthetic sequence
actagtgaagatc

SEQ ID NO: 6918 - DNA, 13 bp, Artificial Sequence
  synthetic sequence
ggaggaaccgatg

SEQ ID NO: 6919 - DNA, 13 bp, Artificial Sequence
  synthetic sequence
ataagcattgaaa

SEQ ID NO: 6920 - DNA, 13 bp, Artificial Sequence
  synthetic sequence
ataactttcgtta

SEQ ID NO: 6921 - DNA, 13 bp, Artificial Sequence
  synthetic sequence
ctgcgtagacgat

SEQ ID NO: 6922 - DNA, 13 bp, Artificial Sequence
  synthetic sequence
agcataaaaccga

SEQ ID NO: 6923 - DNA, 13 bp, Artificial Sequence
  synthetic sequence
gggcggtatcctc

SEQ ID NO: 6924 - DNA, 13 bp, Artificial Sequence
  synthetic sequence
aactgaaacatct

SEQ ID NO: 6925 - DNA, 13 bp, Artificial Sequence
  synthetic sequence
gaccggaatggac

SEQ ID NO: 6926 - DNA, 13 bp, Artificial Sequence
  synthetic sequence
gagttttaaaaga

SEQ ID NO: 6927 - DNA, 13 bp, Artificial Sequence
  synthetic sequence
caattaaagcggt

SEQ ID NO: 6928 - DNA, 13 bp, Artificial Sequence
  synthetic sequence
ggggccgcagaga

SEQ ID NO: 6929 - DNA, 13 bp, Artificial Sequence
  synthetic sequence
gagaaagaccgac

SEQ ID NO: 6930 - DNA, 13 bp, Artificial Sequence
  synthetic sequence
ttgaaatactggt

SEQ ID NO: 6931 - DNA, 13 bp, Artificial Sequence
  synthetic sequence
ggataaaggatca

SEQ ID NO: 6932 - DNA, 13 bp, Artificial Sequence
  synthetic sequence
tgaagaagcgagg

SEQ ID NO: 6933 - DNA, 13 bp, Artificial Sequence
  synthetic sequence
gtattggttagct

SEQ ID NO: 6934 - DNA, 13 bp, Artificial Sequence
  synthetic sequence
gttaagcgacggc

SEQ ID NO: 6935 - DNA, 13 bp, Artificial Sequence
  synthetic sequence
tttggtacggtca

SEQ ID NO: 6936 - DNA, 13 bp, Artificial Sequence
  synthetic sequence
gggcttacggcga

SEQ ID NO: 6937 - DNA, 13 bp, Artificial Sequence
  synthetic sequence
ctttcgttgagac

SEQ ID NO: 6938 - DNA, 13 bp, Artificial Sequence
  synthetic sequence
ataacaaaccaaa

SEQ ID NO: 6939 - DNA, 13 bp, Artificial Sequence
  synthetic sequence
catagttttaccc

SEQ ID NO: 6940 - DNA, 13 bp, Artificial Sequence
  synthetic sequence
taacctgctgctc

SEQ ID NO: 6941 - DNA, 13 bp, Artificial Sequence
  synthetic sequence
aaccgacacacca

SEQ ID NO: 6942 - DNA, 13 bp, Artificial Sequence
  synthetic sequence
cagggcttaggtt

SEQ ID NO: 6943 - DNA, 13 bp, Artificial Sequence
  synthetic sequence
gtgattgccaacc

SEQ ID NO: 6944 - DNA, 13 bp, Artificial Sequence
  synthetic sequence
actctttaaatga

SEQ ID NO: 6945 - DNA, 13 bp, Artificial Sequence
  synthetic sequence
agaccaaactgtc

SEQ ID NO: 6946 - DNA, 13 bp, Artificial Sequence
  synthetic sequence
agtttgatttccg

SEQ ID NO: 6947 - DNA, 13 bp, Artificial Sequence
  synthetic sequence
gccgacatcgagg

SEQ ID NO: 6948 - DNA, 13 bp, Artificial Sequence
  synthetic sequence
gtagtctacatgg

SEQ ID NO: 6949 - DNA, 13 bp, Artificial Sequence
  synthetic sequence
cgccgctacacag

SEQ ID NO: 6950 - DNA, 13 bp, Artificial Sequence
  synthetic sequence
gactagtatttag

SEQ ID NO: 6951 - DNA, 13 bp, Artificial Sequence
  synthetic sequence
agtcaccctaaaa

SEQ ID NO: 6952 - DNA, 13 bp, Artificial Sequence
  synthetic sequence
ataaaattaggga

SEQ ID NO: 6953 - DNA, 13 bp, Artificial Sequence
  synthetic sequence
tactacgctctcc

SEQ ID NO: 6954 - DNA, 13 bp, Artificial Sequence
  synthetic sequence
ctatttcactccc

SEQ ID NO: 6955 - DNA, 13 bp, Artificial Sequence
  synthetic sequence
acaccatatactt

SEQ ID NO: 6956 - DNA, 13 bp, Artificial Sequence
  synthetic sequence
agcggatttgcct

SEQ ID NO: 6957 - DNA, 13 bp, Artificial Sequence
  synthetic sequence
cccttaacctcgc

SEQ ID NO: 6958 - DNA, 13 bp, Artificial Sequence
  synthetic sequence
actatcaccctgt

SEQ ID NO: 6959 - DNA, 13 bp, Artificial Sequence
  synthetic sequence
gaataatgttaga

SEQ ID NO: 6960 - DNA, 13 bp, Artificial Sequence
  synthetic sequence
ctccaagtttgat

SEQ ID NO: 6961 - DNA, 13 bp, Artificial Sequence
  synthetic sequence
atggtcaagtgaa

SEQ ID NO: 6962 - DNA, 13 bp, Artificial Sequence
  synthetic sequence
tccgaatggggaa

SEQ ID NO: 6963 - DNA, 13 bp, Artificial Sequence
  synthetic sequence
ctaaaaacacagc

SEQ ID NO: 6964 - DNA, 13 bp, Artificial Sequence
  synthetic sequence
acgataatgtggg

SEQ ID NO: 6965 - DNA, 13 bp, Artificial Sequence
  synthetic sequence
atagccccgtacg

SEQ ID NO: 6966 - DNA, 13 bp, Artificial Sequence
  synthetic sequence
gggagtgaaatag

SEQ ID NO: 6967 - DNA, 13 bp, Artificial Sequence
  synthetic sequence
tgccatctgtctt

SEQ ID NO: 6968 - DNA, 13 bp, Artificial Sequence
  synthetic sequence
ggtattgtaaaac

SEQ ID NO: 6969 - DNA, 13 bp, Artificial Sequence
  synthetic sequence
acgatgtgggaag

SEQ ID NO: 6970 - DNA, 13 bp, Artificial Sequence
  synthetic sequence
ttattttaattgc

SEQ ID NO: 6971 - DNA, 13 bp, Artificial Sequence
  synthetic sequence
catctaagtaccc

SEQ ID NO: 6972 - DNA, 13 bp, Artificial Sequence
  synthetic sequence
tgactgaacatgg

SEQ ID NO: 6973 - DNA, 13 bp, Artificial Sequence
  synthetic sequence
ctcggagatagct

SEQ ID NO: 6974 - DNA, 13 bp, Artificial Sequence
  synthetic sequence
tatctagctttga

SEQ ID NO: 6975 - DNA, 13 bp, Artificial Sequence
  synthetic sequence
taatattcccgta

SEQ ID NO: 6976 - DNA, 13 bp, Artificial Sequence
  synthetic sequence
gagcttaaccgtc

SEQ ID NO: 6977 - DNA, 13 bp, Artificial Sequence
  synthetic sequence
atggggttagccc

SEQ ID NO: 6978 - DNA, 13 bp, Artificial Sequence
  synthetic sequence
ctcactggtcgag

SEQ ID NO: 6979 - DNA, 13 bp, Artificial Sequence
  synthetic sequence
cgcaataactatc

SEQ ID NO: 6980 - DNA, 13 bp, Artificial Sequence
  synthetic sequence
ttcgggagaaggt

SEQ ID NO: 6981 - DNA, 13 bp, Artificial Sequence
  synthetic sequence
attggcaagccaa

SEQ ID NO: 6982 - DNA, 13 bp, Artificial Sequence
  synthetic sequence
tcaggtaacactg

SEQ ID NO: 6983 - DNA, 13 bp, Artificial Sequence
  synthetic sequence
ccaagaagtttta

SEQ ID NO: 6984 - DNA, 13 bp, Artificial Sequence
  synthetic sequence
gtggtttaagtgt

SEQ ID NO: 6985 - DNA, 13 bp, Artificial Sequence
  synthetic sequence
gatttttactacc

SEQ ID NO: 6986 - DNA, 13 bp, Artificial Sequence
  synthetic sequence
tctgtcatctgtc

SEQ ID NO: 6987 - DNA, 13 bp, Artificial Sequence
  synthetic sequence
ggatggctgcttc

SEQ ID NO: 6988 - DNA, 13 bp, Artificial Sequence
  synthetic sequence
atacgtcctctta

SEQ ID NO: 6989 - DNA, 13 bp, Artificial Sequence
  synthetic sequence
ctggttcgctatc

SEQ ID NO: 6990 - DNA, 13 bp, Artificial Sequence
  synthetic sequence
cgggatggccccc

SEQ ID NO: 6991 - DNA, 13 bp, Artificial Sequence
  synthetic sequence
ggtctactcgttg

SEQ ID NO: 6992 - DNA, 13 bp, Artificial Sequence
  synthetic sequence
cccaggttcgcct

SEQ ID NO: 6993 - DNA, 13 bp, Artificial Sequence
  synthetic sequence
cccttcagcaata

SEQ ID NO: 6994 - DNA, 13 bp, Artificial Sequence
  synthetic sequence
catcccctaattt

SEQ ID NO: 6995 - DNA, 13 bp, Artificial Sequence
  synthetic sequence
ctttcgctcgccg

SEQ ID NO: 6996 - DNA, 13 bp, Artificial Sequence
  synthetic sequence
agttagtttatga

SEQ ID NO: 6997 - DNA, 13 bp, Artificial Sequence
  synthetic sequence
ttatacaaaaggt

SEQ ID NO: 6998 - DNA, 13 bp, Artificial Sequence
  synthetic sequence
caagcgccttggt

SEQ ID NO: 6999 - DNA, 13 bp, Artificial Sequence
  synthetic sequence
ataaaaattaact

SEQ ID NO: 7000 - DNA, 13 bp, Artificial Sequence
  synthetic sequence
ctttgcacgaaca

SEQ ID NO: 7001 - DNA, 13 bp, Artificial Sequence
  synthetic sequence
gcaaggaccttca

SEQ ID NO: 7002 - DNA, 13 bp, Artificial Sequence
  synthetic sequence
gtggctgacctag

SEQ ID NO: 7003 - DNA, 13 bp, Artificial Sequence
  synthetic sequence
acccacattattt

SEQ ID NO: 7004 - DNA, 13 bp, Artificial Sequence
  synthetic sequence
ttcgcacttctga

SEQ ID NO: 7005 - DNA, 13 bp, Artificial Sequence
  synthetic sequence
atttacgtaacta

SEQ ID NO: 7006 - DNA, 13 bp, Artificial Sequence
  synthetic sequence
gctgtttcccttt

SEQ ID NO: 7007 - DNA, 13 bp, Artificial Sequence
  synthetic sequence
cctaaatcaaaac

SEQ ID NO: 7008 - DNA, 13 bp, Artificial Sequence
  synthetic sequence
cttaggggccgac

SEQ ID NO: 7009 - DNA, 13 bp, Artificial Sequence
  synthetic sequence
tggcattcagagg

SEQ ID NO: 7010 - DNA, 13 bp, Artificial Sequence
  synthetic sequence
gcccggtgctgga

SEQ ID NO: 7011 - DNA, 13 bp, Artificial Sequence
  synthetic sequence
ggtactccgggga

SEQ ID NO: 7012 - DNA, 13 bp, Artificial Sequence
  synthetic sequence
accccgtgaacct

SEQ ID NO: 7013 - DNA, 13 bp, Artificial Sequence
  synthetic sequence
agggtatggctgt

SEQ ID NO: 7014 - DNA, 13 bp, Artificial Sequence
  synthetic sequence
aagtgggaagagc

SEQ ID NO: 7015 - DNA, 13 bp, Artificial Sequence
  synthetic sequence
actgcgagagtga

SEQ ID NO: 7016 - DNA, 13 bp, Artificial Sequence
  synthetic sequence
aggaccgaaccca

SEQ ID NO: 7017 - DNA, 13 bp, Artificial Sequence
  synthetic sequence
tgttgggggttgc

SEQ ID NO: 7018 - DNA, 13 bp, Artificial Sequence
  synthetic sequence
tgctggaggtatc

SEQ ID NO: 7019 - DNA, 13 bp, Artificial Sequence
  synthetic sequence
cctgcacgaatgg

SEQ ID NO: 7020 - DNA, 13 bp, Artificial Sequence
  synthetic sequence
agaggaccggagt

SEQ ID NO: 7021 - DNA, 13 bp, Artificial Sequence
  synthetic sequence
aagatttaacggg

SEQ ID NO: 7022 - DNA, 13 bp, Artificial Sequence
  synthetic sequence
gtcccgtatacga

SEQ ID NO: 7023 - DNA, 13 bp, Artificial Sequence
  synthetic sequence
tagagaatactaa

SEQ ID NO: 7024 - DNA, 13 bp, Artificial Sequence
  synthetic sequence
gtaaagcactgtt

SEQ ID NO: 7025 - DNA, 13 bp, Artificial Sequence
  synthetic sequence
gggagacacactg

SEQ ID NO: 7026 - DNA, 13 bp, Artificial Sequence
  synthetic sequence
atggttgtccagg

SEQ ID NO: 7027 - DNA, 13 bp, Artificial Sequence
  synthetic sequence
tagggtaagccgg

SEQ ID NO: 7028 - DNA, 13 bp, Artificial Sequence
  synthetic sequence
aggctaaatactc

SEQ ID NO: 7029 - DNA, 13 bp, Artificial Sequence
  synthetic sequence
aagagtaacggag

SEQ ID NO: 7030 - DNA, 13 bp, Artificial Sequence
  synthetic sequence
aggcccagacagc

SEQ ID NO: 7031 - DNA, 13 bp, Artificial Sequence
  synthetic sequence
cgtagcgaaagcg

SEQ ID NO: 7032 - DNA, 13 bp, Artificial Sequence
  synthetic sequence
atgtgactgcgta

SEQ ID NO: 7033 - DNA, 13 bp, Artificial Sequence
  synthetic sequence
gaaagcatctaag

SEQ ID NO: 7034 - DNA, 13 bp, Artificial Sequence
  synthetic sequence
agctattgatacc

SEQ ID NO: 7035 - DNA, 13 bp, Artificial Sequence
  synthetic sequence
ggggaacccacct

SEQ ID NO: 7036 - DNA, 13 bp, Artificial Sequence
  synthetic sequence
gctacgccagtag

SEQ ID NO: 7037 - DNA, 13 bp, Artificial Sequence
  synthetic sequence
agactttgaagca

SEQ ID NO: 7038 - DNA, 13 bp, Artificial Sequence
  synthetic sequence
aggtactcactcg

SEQ ID NO: 7039 - DNA, 13 bp, Artificial Sequence
  synthetic sequence
tcattagtactgg

SEQ ID NO: 7040 - DNA, 13 bp, Artificial Sequence
  synthetic sequence
gccgtttactggg

SEQ ID NO: 7041 - DNA, 13 bp, Artificial Sequence
  synthetic sequence
cccaggatgtgat

SEQ ID NO: 7042 - DNA, 13 bp, Artificial Sequence
  synthetic sequence
aatatacttagaa

SEQ ID NO: 7043 - DNA, 13 bp, Artificial Sequence
  synthetic sequence
ccttcttccaaag

SEQ ID NO: 7044 - DNA, 13 bp, Artificial Sequence
  synthetic sequence
tcctaagggtact

SEQ ID NO: 7045 - DNA, 13 bp, Artificial Sequence
  synthetic sequence
taccgagtgcacc

SEQ ID NO: 7046 - DNA, 13 bp, Artificial Sequence
  synthetic sequence
ggccatggataga

SEQ ID NO: 7047 - DNA, 13 bp, Artificial Sequence
  synthetic sequence
gagctattacgct

SEQ ID NO: 7048 - DNA, 13 bp, Artificial Sequence
  synthetic sequence
cccaacttgttct

SEQ ID NO: 7049 - DNA, 13 bp, Artificial Sequence
  synthetic sequence
gtgctgtgttttt

SEQ ID NO: 7050 - DNA, 13 bp, Artificial Sequence
  synthetic sequence
aacgctcccctac

SEQ ID NO: 7051 - DNA, 13 bp, Artificial Sequence
  synthetic sequence
gaggatggtcccc

SEQ ID NO: 7052 - DNA, 13 bp, Artificial Sequence
  synthetic sequence
tttcggccaataa

SEQ ID NO: 7053 - DNA, 13 bp, Artificial Sequence
  synthetic sequence
ttcaatttcactg

SEQ ID NO: 7054 - DNA, 13 bp, Artificial Sequence
  synthetic sequence
gattctatttcac

SEQ ID NO: 7055 - DNA, 13 bp, Artificial Sequence
  synthetic sequence
tattcagttatcc

SEQ ID NO: 7056 - DNA, 13 bp, Artificial Sequence
  synthetic sequence
gtccagtgcaaag

SEQ ID NO: 7057 - DNA, 13 bp, Artificial Sequence
  synthetic sequence
ccggatcactaag

SEQ ID NO: 7058 - DNA, 13 bp, Artificial Sequence
  synthetic sequence
cccacggcagata

SEQ ID NO: 7059 - DNA, 13 bp, Artificial Sequence
  synthetic sequence
ccagctatctccg

SEQ ID NO: 7060 - DNA, 13 bp, Artificial Sequence
  synthetic sequence
ctgagttagaact

SEQ ID NO: 7061 - DNA, 13 bp, Artificial Sequence
  synthetic sequence
ggctgtttccctt

SEQ ID NO: 7062 - DNA, 13 bp, Artificial Sequence
  synthetic sequence
tcgtagtctccaa

SEQ ID NO: 7063 - DNA, 13 bp, Artificial Sequence
  synthetic sequence
aggaatattaacc

SEQ ID NO: 7064 - DNA, 13 bp, Artificial Sequence
  synthetic sequence
gagtcagtaaggt

SEQ ID NO: 7065 - DNA, 13 bp, Artificial Sequence
  synthetic sequence
ttctggcgaaaca

SEQ ID NO: 7066 - DNA, 13 bp, Artificial Sequence
  synthetic sequence
ccggatttgccta

SEQ ID NO: 7067 - DNA, 13 bp, Artificial Sequence
  synthetic sequence
agcaagcttaagc

SEQ ID NO: 7068 - DNA, 13 bp, Artificial Sequence
  synthetic sequence
gcaaagtcaatag

SEQ ID NO: 7069 - DNA, 13 bp, Artificial Sequence
  synthetic sequence
tagtcgagaggga

SEQ ID NO: 7070 - DNA, 13 bp, Artificial Sequence
  synthetic sequence
tgtcggctcatca

SEQ ID NO: 7071 - DNA, 13 bp, Artificial Sequence
  synthetic sequence
gtaatagctcact

SEQ ID NO: 7072 - DNA, 13 bp, Artificial Sequence
  synthetic sequence
taactatgacggt

SEQ ID NO: 7073 - DNA, 13 bp, Artificial Sequence
  synthetic sequence
agaacgtcgtgag

SEQ ID NO: 7074 - DNA, 13 bp, Artificial Sequence
  synthetic sequence
caggttaatattc

SEQ ID NO: 7075 - DNA, 13 bp, Artificial Sequence
  synthetic sequence
atgctgaaggaac

SEQ ID NO: 7076 - DNA, 13 bp, Artificial Sequence
  synthetic sequence
agtgatccggtgg

SEQ ID NO: 7077 - DNA, 13 bp, Artificial Sequence
  synthetic sequence
agacccgaaaccg

SEQ ID NO: 7078 - DNA, 13 bp, Artificial Sequence
  synthetic sequence
ctgtctccagtat

SEQ ID NO: 7079 - DNA, 13 bp, Artificial Sequence
  synthetic sequence
ggtagcggagcgt

SEQ ID NO: 7080 - DNA, 13 bp, Artificial Sequence
  synthetic sequence
gttggtcggaaat

SEQ ID NO: 7081 - DNA, 13 bp, Artificial Sequence
  synthetic sequence
caaactcggatat

SEQ ID NO: 7082 - DNA, 13 bp, Artificial Sequence
  synthetic sequence
agctgggtagcta

SEQ ID NO: 7083 - DNA, 13 bp, Artificial Sequence
  synthetic sequence
tgcaggataggtg

SEQ ID NO: 7084 - DNA, 13 bp, Artificial Sequence
  synthetic sequence
ctgaatgagctag

SEQ ID NO: 7085 - DNA, 13 bp, Artificial Sequence
  synthetic sequence
gcgataaagaatg

SEQ ID NO: 7086 - DNA, 13 bp, Artificial Sequence
  synthetic sequence
atattttccagga

SEQ ID NO: 7087 - DNA, 13 bp, Artificial Sequence
  synthetic sequence
agagccgtggaag

SEQ ID NO: 7088 - DNA, 13 bp, Artificial Sequence
  synthetic sequence
tccttgaatcagg

SEQ ID NO: 7089 - DNA, 13 bp, Artificial Sequence
  synthetic sequence
atctaaccgagac

SEQ ID NO: 7090 - DNA, 13 bp, Artificial Sequence
  synthetic sequence
aatattgtccagg

SEQ ID NO: 7091 - DNA, 13 bp, Artificial Sequence
  synthetic sequence
acttccccattag

SEQ ID NO: 7092 - DNA, 13 bp, Artificial Sequence
  synthetic sequence
ggtcatacaggct

SEQ ID NO: 7093 - DNA, 13 bp, Artificial Sequence
  synthetic sequence
tctccccattaaa

SEQ ID NO: 7094 - DNA, 13 bp, Artificial Sequence
  synthetic sequence
aatcgagctatta

SEQ ID NO: 7095 - DNA, 13 bp, Artificial Sequence
  synthetic sequence
gcttagatgcatt

SEQ ID NO: 7096 - DNA, 13 bp, Artificial Sequence
  synthetic sequence
acgtaccacttta

SEQ ID NO: 7097 - DNA, 13 bp, Artificial Sequence
  synthetic sequence
gaccgccccagtc

SEQ ID NO: 7098 - DNA, 13 bp, Artificial Sequence
  synthetic sequence
acaaggaatttcg

SEQ ID NO: 7099 - DNA, 13 bp, Artificial Sequence
  synthetic sequence
ctagcttatgcca

SEQ ID NO: 7100 - DNA, 13 bp, Artificial Sequence
  synthetic sequence
tcggtcctctcgt

SEQ ID NO: 7101 - DNA, 13 bp, Artificial Sequence
  synthetic sequence
tagttgttttggt

SEQ ID NO: 7102 - DNA, 13 bp, Artificial Sequence
  synthetic sequence
cctgttatccccg

SEQ ID NO: 7103 - DNA, 13 bp, Artificial Sequence
  synthetic sequence
ctacctaaataga

SEQ ID NO: 7104 - DNA, 13 bp, Artificial Sequence
  synthetic sequence
acttccgatacct

SEQ ID NO: 7105 - DNA, 13 bp, Artificial Sequence
  synthetic sequence
cgccttggtatac

SEQ ID NO: 7106 - DNA, 13 bp, Artificial Sequence
  synthetic sequence
taatcttccagca

SEQ ID NO: 7107 - DNA, 13 bp, Artificial Sequence
  synthetic sequence
gccccgttacatt

SEQ ID NO: 7108 - DNA, 13 bp, Artificial Sequence
  synthetic sequence
ctccacaaaggct

SEQ ID NO: 7109 - DNA, 13 bp, Artificial Sequence
  synthetic sequence
cgcaagaaccctt

SEQ ID NO: 7110 - DNA, 13 bp, Artificial Sequence
  synthetic sequence
tcatcccctactt

SEQ ID NO: 7111 - DNA, 13 bp, Artificial Sequence
  synthetic sequence
gggaactccgcat

SEQ ID NO: 7112 - DNA, 13 bp, Artificial Sequence
  synthetic sequence
ccttagcacccat

SEQ ID NO: 7113 - DNA, 13 bp, Artificial Sequence
  synthetic sequence
tcaatccaataag

SEQ ID NO: 7114 - DNA, 13 bp, Artificial Sequence
  synthetic sequence
ttgtgccacctgc

SEQ ID NO: 7115 - DNA, 13 bp, Artificial Sequence
  synthetic sequence
gctaccccctagc

SEQ ID NO: 7116 - DNA, 13 bp, Artificial Sequence
  synthetic sequence
tagtaccagttag

SEQ ID NO: 7117 - DNA, 13 bp, Artificial Sequence
  synthetic sequence
cgactaaccctgc

SEQ ID NO: 7118 - DNA, 13 bp, Artificial Sequence
  synthetic sequence
ctgttatgctata

SEQ ID NO: 7119 - DNA, 13 bp, Artificial Sequence
  synthetic sequence
ctaacaaaatgaa

SEQ ID NO: 7120 - DNA, 13 bp, Artificial Sequence
  synthetic sequence
ccagattgacgac

SEQ ID NO: 7121 - DNA, 13 bp, Artificial Sequence
  synthetic sequence
cggtggcaggaat

SEQ ID NO: 7122 - DNA, 13 bp, Artificial Sequence
  synthetic sequence
gggactgggtatt

SEQ ID NO: 7123 - DNA, 13 bp, Artificial Sequence
  synthetic sequence
gcgggtacttctt

SEQ ID NO: 7124 - DNA, 13 bp, Artificial Sequence
  synthetic sequence
agggcaagtgggc

SEQ ID NO: 7125 - DNA, 13 bp, Artificial Sequence
  synthetic sequence
agcagacacagcc

SEQ ID NO: 7126 - DNA, 13 bp, Artificial Sequence
  synthetic sequence
aggtgagatctct

SEQ ID NO: 7127 - DNA, 13 bp, Artificial Sequence
  synthetic sequence
agagcaagcacgc

SEQ ID NO: 7128 - DNA, 13 bp, Artificial Sequence
  synthetic sequence
ccccagacactac

SEQ ID NO: 7129 - DNA, 13 bp, Artificial Sequence
  synthetic sequence
tcatgatggagaa

SEQ ID NO: 7130 - DNA, 13 bp, Artificial Sequence
  synthetic sequence
agaacccctccat

SEQ ID NO: 7131 - DNA, 13 bp, Artificial Sequence
  synthetic sequence
agaacgcagtggc

SEQ ID NO: 7132 - DNA, 13 bp, Artificial Sequence
  synthetic sequence
tcctttgttatta

SEQ ID NO: 7133 - DNA, 13 bp, Artificial Sequence
  synthetic sequence
tcttcagggcctt

SEQ ID NO: 7134 - DNA, 13 bp, Artificial Sequence
  synthetic sequence
gagctagagagtg

SEQ ID NO: 7135 - DNA, 13 bp, Artificial Sequence
  synthetic sequence
tgcctaaggagaa

SEQ ID NO: 7136 - DNA, 13 bp, Artificial Sequence
  synthetic sequence
tagttgcatatga

SEQ ID NO: 7137 - DNA, 13 bp, Artificial Sequence
  synthetic sequence
aaggtaatcgtcc

SEQ ID NO: 7138 - DNA, 13 bp, Artificial Sequence
  synthetic sequence
agcatgtattcac

SEQ ID NO: 7139 - DNA, 13 bp, Artificial Sequence
  synthetic sequence
ctggctcaaccac

SEQ ID NO: 7140 - DNA, 13 bp, Artificial Sequence
  synthetic sequence
cacaagcttaggc

SEQ ID NO: 7141 - DNA, 13 bp, Artificial Sequence
  synthetic sequence
aatcggtacactg

SEQ ID NO: 7142 - DNA, 13 bp, Artificial Sequence
  synthetic sequence
agtgatatgtgct

SEQ ID NO: 7143 - DNA, 13 bp, Artificial Sequence
  synthetic sequence
atatgaaccccca

SEQ ID NO: 7144 - DNA, 13 bp, Artificial Sequence
  synthetic sequence
aggagtttgaggc

SEQ ID NO: 7145 - DNA, 13 bp, Artificial Sequence
  synthetic sequence
agtgcaagttgta

SEQ ID NO: 7146 - DNA, 13 bp, Artificial Sequence
  synthetic sequence
caacaatgatgcc

SEQ ID NO: 7147 - DNA, 13 bp, Artificial Sequence
  synthetic sequence
tatactcctctgt

SEQ ID NO: 7148 - DNA, 13 bp, Artificial Sequence
  synthetic sequence
atagcaccctatc

SEQ ID NO: 7149 - DNA, 13 bp, Artificial Sequence
  synthetic sequence
gcatgatcgaggc

SEQ ID NO: 7150 - DNA, 13 bp, Artificial Sequence
  synthetic sequence
aaggcttgggaat

SEQ ID NO: 7151 - DNA, 13 bp, Artificial Sequence
  synthetic sequence
tgcctcgtgaatc

SEQ ID NO: 7152 - DNA, 13 bp, Artificial Sequence
  synthetic sequence
caagcatgctaga

SEQ ID NO: 7153 - DNA, 13 bp, Artificial Sequence
  synthetic sequence
cgtgatctcaccg

SEQ ID NO: 7154 - DNA, 13 bp, Artificial Sequence
  synthetic sequence
gttgagctgcctc

SEQ ID NO: 7155 - DNA, 13 bp, Artificial Sequence
  synthetic sequence
acaatgccgtttg

SEQ ID NO: 7156 - DNA, 13 bp, Artificial Sequence
  synthetic sequence
ttcatcaacccgg

SEQ ID NO: 7157 - DNA, 13 bp, Artificial Sequence
  synthetic sequence
cgcgcatttatcc

SEQ ID NO: 7158 - DNA, 13 bp, Artificial Sequence
  synthetic sequence
gcttaagcgggtc

SEQ ID NO: 7159 - DNA, 13 bp, Artificial Sequence
  synthetic sequence
caagactcagccc

SEQ ID NO: 7160 - DNA, 13 bp, Artificial Sequence
  synthetic sequence
cgccgttgctctc

SEQ ID NO: 7161 - DNA, 13 bp, Artificial Sequence
  synthetic sequence
gacagctcagcgg

SEQ ID NO: 7162 - DNA, 13 bp, Artificial Sequence
  synthetic sequence
gcggttgggacta

SEQ ID NO: 7163 - DNA, 13 bp, Artificial Sequence
  synthetic sequence
gtcgtgaacaaaa

SEQ ID NO: 7164 - DNA, 13 bp, Artificial Sequence
  synthetic sequence
ccctgagcagata

SEQ ID NO: 7165 - DNA, 13 bp, Artificial Sequence
  synthetic sequence
tctgccgatgctc

SEQ ID NO: 7166 - DNA, 13 bp, Artificial Sequence
  synthetic sequence
ccagtgtcttttt

SEQ ID NO: 7167 - DNA, 13 bp, Artificial Sequence
  synthetic sequence
tcaatcaatgtga

SEQ ID NO: 7168 - DNA, 13 bp, Artificial Sequence
  synthetic sequence
ctatactcaaagt

SEQ ID NO: 7169 - DNA, 13 bp, Artificial Sequence
  synthetic sequence
agtcaagggctgc

SEQ ID NO: 7170 - DNA, 13 bp, Artificial Sequence
  synthetic sequence
agccgagcagatc

SEQ ID NO: 7171 - DNA, 13 bp, Artificial Sequence
  synthetic sequence
tcaggaggtggat

SEQ ID NO: 7172 - DNA, 13 bp, Artificial Sequence
  synthetic sequence
ctcctcctcatgg

SEQ ID NO: 7173 - DNA, 13 bp, Artificial Sequence
  synthetic sequence
gttgtattgcccc

SEQ ID NO: 7174 - DNA, 13 bp, Artificial Sequence
  synthetic sequence
ccaggtaaagaat

SEQ ID NO: 7175 - DNA, 13 bp, Artificial Sequence
  synthetic sequence
agataattgctct

SEQ ID NO: 7176 - DNA, 13 bp, Artificial Sequence
  synthetic sequence
caccatctgacta

SEQ ID NO: 7177 - DNA, 13 bp, Artificial Sequence
  synthetic sequence
gaaggttgtcatt

SEQ ID NO: 7178 - DNA, 13 bp, Artificial Sequence
  synthetic sequence
tggtgtacctgtc

SEQ ID NO: 7179 - DNA, 13 bp, Artificial Sequence
  synthetic sequence
ttgttatggggag

SEQ ID NO: 7180 - DNA, 13 bp, Artificial Sequence
  synthetic sequence
acgggagcagctc

SEQ ID NO: 7181 - DNA, 13 bp, Artificial Sequence
  synthetic sequence
tttcagtgaaaga

SEQ ID NO: 7182 - DNA, 13 bp, Artificial Sequence
  synthetic sequence
tgcgaggttagtt

SEQ ID NO: 7183 - DNA, 13 bp, Artificial Sequence
  synthetic sequence
cctccggctgaca

SEQ ID NO: 7184 - DNA, 13 bp, Artificial Sequence
  synthetic sequence
agggacctacttg

SEQ ID NO: 7185 - DNA, 13 bp, Artificial Sequence
  synthetic sequence
atagatctatttc

SEQ ID NO: 7186 - DNA, 13 bp, Artificial Sequence
  synthetic sequence
ttccatacaccag

SEQ ID NO: 7187 - DNA, 13 bp, Artificial Sequence
  synthetic sequence
tccctttcttggt

SEQ ID NO: 7188 - DNA, 13 bp, Artificial Sequence
  synthetic sequence
cgttcatggcgtg

SEQ ID NO: 7189 - DNA, 13 bp, Artificial Sequence
  synthetic sequence
atggatctgtaca

SEQ ID NO: 7190 - DNA, 13 bp, Artificial Sequence
  synthetic sequence
ctggagattcctt

SEQ ID NO: 7191 - DNA, 13 bp, Artificial Sequence
  synthetic sequence
ccacacttgaaca

SEQ ID NO: 7192 - DNA, 13 bp, Artificial Sequence
  synthetic sequence
ttacttgagatgg

SEQ ID NO: 7193 - DNA, 13 bp, Artificial Sequence
  synthetic sequence
cgggcctccacca

SEQ ID NO: 7194 - DNA, 13 bp, Artificial Sequence
  synthetic sequence
atgcgaagtggcc

SEQ ID NO: 7195 - DNA, 13 bp, Artificial Sequence
  synthetic sequence
aatccacatgagg

SEQ ID NO: 7196 - DNA, 13 bp, Artificial Sequence
  synthetic sequence
cagcccgtcctag

SEQ ID NO: 7197 - DNA, 13 bp, Artificial Sequence
  synthetic sequence
ggttatgccatac

SEQ ID NO: 7198 - DNA, 13 bp, Artificial Sequence
  synthetic sequence
accccgacgctat

SEQ ID NO: 7199 - DNA, 13 bp, Artificial Sequence
  synthetic sequence
ggtctgttagaca

SEQ ID NO: 7200 - DNA, 13 bp, Artificial Sequence
  synthetic sequence
ttgtgaatgctct

SEQ ID NO: 7201 - DNA, 13 bp, Artificial Sequence
  synthetic sequence
tcactcccccatc

SEQ ID NO: 7202 - DNA, 13 bp, Artificial Sequence
  synthetic sequence
atggacctcatta

SEQ ID NO: 7203 - DNA, 13 bp, Artificial Sequence
  synthetic sequence
ctggtccaggtgt

SEQ ID NO: 7204 - DNA, 13 bp, Artificial Sequence
  synthetic sequence
gttggtggttgat

SEQ ID NO: 7205 - DNA, 13 bp, Artificial Sequence
  synthetic sequence
tcactgtaggggg

SEQ ID NO: 7206 - DNA, 13 bp, Artificial Sequence
  synthetic sequence
gccaagggctcac

SEQ ID NO: 7207 - DNA, 13 bp, Artificial Sequence
  synthetic sequence
cacggcaggggct

SEQ ID NO: 7208 - DNA, 13 bp, Artificial Sequence
  synthetic sequence
gccacctactacc

SEQ ID NO: 7209 - DNA, 13 bp, Artificial Sequence
  synthetic sequence
ccctctgctgcca

SEQ ID NO: 7210 - DNA, 13 bp, Artificial Sequence
  synthetic sequence
gctggaatcagcc

SEQ ID NO: 7211 - DNA, 13 bp, Artificial Sequence
  synthetic sequence
ttgttgctcttcg

SEQ ID NO: 7212 - DNA, 13 bp, Artificial Sequence
  synthetic sequence
ctaacaaaatgaa

SEQ ID NO: 7213 - DNA, 13 bp, Artificial Sequence
  synthetic sequence
ccagattgacgac

SEQ ID NO: 7214 - DNA, 13 bp, Artificial Sequence
  synthetic sequence
cggtggcaggaat

SEQ ID NO: 7215 - DNA, 13 bp, Artificial Sequence
  synthetic sequence
gggactgggtatt

SEQ ID NO: 7216 - DNA, 13 bp, Artificial Sequence
  synthetic sequence
gcgggtacttctt

SEQ ID NO: 7217 - DNA, 13 bp, Artificial Sequence
  synthetic sequence
agggcaagtgggc

SEQ ID NO: 7218 - DNA, 13 bp, Artificial Sequence
  synthetic sequence
agcagacacagcc

SEQ ID NO: 7219 - DNA, 13 bp, Artificial Sequence
  synthetic sequence
aggtgagatctct

SEQ ID NO: 7220 - DNA, 13 bp, Artificial Sequence
  synthetic sequence
agagcaagcacgc

SEQ ID NO: 7221 - DNA, 13 bp, Artificial Sequence
  synthetic sequence
ccccagacactac

SEQ ID NO: 7222 - DNA, 13 bp, Artificial Sequence
  synthetic sequence
tcatgatggagaa

SEQ ID NO: 7223 - DNA, 13 bp, Artificial Sequence
  synthetic sequence
agaacccctccat

SEQ ID NO: 7224 - DNA, 13 bp, Artificial Sequence
  synthetic sequence
agaacgcagtggc

SEQ ID NO: 7225 - DNA, 13 bp, Artificial Sequence
  synthetic sequence
tcctttgttatta

SEQ ID NO: 7226 - DNA, 13 bp, Artificial Sequence
  synthetic sequence
tcttcagggcctt

SEQ ID NO: 7227 - DNA, 13 bp, Artificial Sequence
  synthetic sequence
gagctagagagtg

SEQ ID NO: 7228 - DNA, 13 bp, Artificial Sequence
  synthetic sequence
tgcctaaggagaa

SEQ ID NO: 7229 - DNA, 13 bp, Artificial Sequence
  synthetic sequence
tagttgcatatga

SEQ ID NO: 7230 - DNA, 13 bp, Artificial Sequence
  synthetic sequence
aaggtaatcgtcc

SEQ ID NO: 7231 - DNA, 13 bp, Artificial Sequence
  synthetic sequence
agcatgtattcac

SEQ ID NO: 7232 - DNA, 13 bp, Artificial Sequence
  synthetic sequence
ctggctcaaccac

SEQ ID NO: 7233 - DNA, 13 bp, Artificial Sequence
  synthetic sequence
cacaagcttaggc

SEQ ID NO: 7234 - DNA, 13 bp, Artificial Sequence
  synthetic sequence
aatcggtacactg

SEQ ID NO: 7235 - DNA, 13 bp, Artificial Sequence
  synthetic sequence
agtgatatgtgct

SEQ ID NO: 7236 - DNA, 13 bp, Artificial Sequence
  synthetic sequence
atatgaaccccca

SEQ ID NO: 7237 - DNA, 13 bp, Artificial Sequence
  synthetic sequence
aggagtttgaggc

SEQ ID NO: 7238 - DNA, 13 bp, Artificial Sequence
  synthetic sequence
agtgcaagttgta

SEQ ID NO: 7239 - DNA, 13 bp, Artificial Sequence
  synthetic sequence
caacaatgatgcc

SEQ ID NO: 7240 - DNA, 13 bp, Artificial Sequence
  synthetic sequence
tatactcctctgt

SEQ ID NO: 7241 - DNA, 13 bp, Artificial Sequence
  synthetic sequence
atagcaccctatc

SEQ ID NO: 7242 - DNA, 13 bp, Artificial Sequence
  synthetic sequence
gcatgatcgaggc

SEQ ID NO: 7243 - DNA, 13 bp, Artificial Sequence
  synthetic sequence
aaggcttgggaat

SEQ ID NO: 7244 - DNA, 13 bp, Artificial Sequence
  synthetic sequence
tgcctcgtgaatc

SEQ ID NO: 7245 - DNA, 13 bp, Artificial Sequence
  synthetic sequence
caagcatgctaga

SEQ ID NO: 7246 - DNA, 13 bp, Artificial Sequence
  synthetic sequence
cgtgatctcaccg

SEQ ID NO: 7247 - DNA, 13 bp, Artificial Sequence
  synthetic sequence
gttgagctgcctc

SEQ ID NO: 7248 - DNA, 13 bp, Artificial Sequence
  synthetic sequence
acaatgccgtttg

SEQ ID NO: 7249 - DNA, 13 bp, Artificial Sequence
  synthetic sequence
ttcatcaacccgg

SEQ ID NO: 7250 - DNA, 13 bp, Artificial Sequence
  synthetic sequence
cgcgcatttatcc

SEQ ID NO: 7251 - DNA, 13 bp, Artificial Sequence
  synthetic sequence
gcttaagcgggtc

SEQ ID NO: 7252 - DNA, 13 bp, Artificial Sequence
  synthetic sequence
caagactcagccc

SEQ ID NO: 7253 - DNA, 13 bp, Artificial Sequence
  synthetic sequence
cgccgttgctctc

SEQ ID NO: 7254 - DNA, 13 bp, Artificial Sequence
  synthetic sequence
gacagctcagcgg

SEQ ID NO: 7255 - DNA, 13 bp, Artificial Sequence
  synthetic sequence
gcggttgggacta

SEQ ID NO: 7256 - DNA, 13 bp, Artificial Sequence
  synthetic sequence
gtcgtgaacaaaa

SEQ ID NO: 7257 - DNA, 13 bp, Artificial Sequence
  synthetic sequence
ccctgagcagata

SEQ ID NO: 7258 - DNA, 13 bp, Artificial Sequence
  synthetic sequence
tctgccgatgctc

SEQ ID NO: 7259 - DNA, 13 bp, Artificial Sequence
  synthetic sequence
ccagtgtcttttt

SEQ ID NO: 7260 - DNA, 13 bp, Artificial Sequence
  synthetic sequence
tcaatcaatgtga

SEQ ID NO: 7261 - DNA, 13 bp, Artificial Sequence
  synthetic sequence
ctatactcaaagt

SEQ ID NO: 7262 - DNA, 13 bp, Artificial Sequence
  synthetic sequence
agtcaagggctgc

SEQ ID NO: 7263 - DNA, 13 bp, Artificial Sequence
  synthetic sequence
agccgagcagatc

SEQ ID NO: 7264 - DNA, 13 bp, Artificial Sequence
  synthetic sequence
tcaggaggtggat

SEQ ID NO: 7265 - DNA, 13 bp, Artificial Sequence
  synthetic sequence
ctcctcctcatgg

SEQ ID NO: 7266 - DNA, 13 bp, Artificial Sequence
  synthetic sequence
gttgtattgcccc

SEQ ID NO: 7267 - DNA, 13 bp, Artificial Sequence
  synthetic sequence
ccaggtaaagaat

SEQ ID NO: 7268 - DNA, 13 bp, Artificial Sequence
  synthetic sequence
agataattgctct

SEQ ID NO: 7269 - DNA, 13 bp, Artificial Sequence
  synthetic sequence
caccatctgacta

SEQ ID NO: 7270 - DNA, 13 bp, Artificial Sequence
  synthetic sequence
gaaggttgtcatt

SEQ ID NO: 7271 - DNA, 13 bp, Artificial Sequence
  synthetic sequence
tggtgtacctgtc

SEQ ID NO: 7272 - DNA, 13 bp, Artificial Sequence
  synthetic sequence
ttgttatggggag

SEQ ID NO: 7273 - DNA, 13 bp, Artificial Sequence
  synthetic sequence
acgggagcagctc

SEQ ID NO: 7274 - DNA, 13 bp, Artificial Sequence
  synthetic sequence
tttcagtgaaaga

SEQ ID NO: 7275 - DNA, 13 bp, Artificial Sequence
  synthetic sequence
tgcgaggttagtt

SEQ ID NO: 7276 - DNA, 13 bp, Artificial Sequence
  synthetic sequence
cctccggctgaca

SEQ ID NO: 7277 - DNA, 13 bp, Artificial Sequence
  synthetic sequence
agggacctacttg

SEQ ID NO: 7278 - DNA, 13 bp, Artificial Sequence
  synthetic sequence
atagatctatttc

SEQ ID NO: 7279 - DNA, 13 bp, Artificial Sequence
  synthetic sequence
ttccatacaccag

SEQ ID NO: 7280 - DNA, 13 bp, Artificial Sequence
  synthetic sequence
tccctttcttggt

SEQ ID NO: 7281 - DNA, 13 bp, Artificial Sequence
  synthetic sequence
cgttcatggcgtg

SEQ ID NO: 7282 - DNA, 13 bp, Artificial Sequence
  synthetic sequence
atggatctgtaca

SEQ ID NO: 7283 - DNA, 13 bp, Artificial Sequence
  synthetic sequence
ctggagattcctt

SEQ ID NO: 7284 - DNA, 13 bp, Artificial Sequence
  synthetic sequence
ccacacttgaaca

SEQ ID NO: 7285 - DNA, 13 bp, Artificial Sequence
  synthetic sequence
ttacttgagatgg

SEQ ID NO: 7286 - DNA, 13 bp, Artificial Sequence
  synthetic sequence
cgggcctccacca

SEQ ID NO: 7287 - DNA, 13 bp, Artificial Sequence
  synthetic sequence
atgcgaagtggcc

SEQ ID NO: 7288 - DNA, 13 bp, Artificial Sequence
  synthetic sequence
aatccacatgagg

SEQ ID NO: 7289 - DNA, 13 bp, Artificial Sequence
  synthetic sequence
cagcccgtcctag

SEQ ID NO: 7290 - DNA, 13 bp, Artificial Sequence
  synthetic sequence
ggttatgccatac

SEQ ID NO: 7291 - DNA, 13 bp, Artificial Sequence
  synthetic sequence
accccgacgctat

SEQ ID NO: 7292 - DNA, 13 bp, Artificial Sequence
  synthetic sequence
ggtctgttagaca

SEQ ID NO: 7293 - DNA, 13 bp, Artificial Sequence
  synthetic sequence
ttgtgaatgctct

SEQ ID NO: 7294 - DNA, 13 bp, Artificial Sequence
  synthetic sequence
tcactcccccatc

SEQ ID NO: 7295 - DNA, 13 bp, Artificial Sequence
  synthetic sequence
atggacctcatta

SEQ ID NO: 7296 - DNA, 13 bp, Artificial Sequence
  synthetic sequence
ctggtccaggtgt

SEQ ID NO: 7297 - DNA, 13 bp, Artificial Sequence
  synthetic sequence
gttggtggttgat

SEQ ID NO: 7298 - DNA, 13 bp, Artificial Sequence
  synthetic sequence
tcactgtaggggg

SEQ ID NO: 7299 - DNA, 13 bp, Artificial Sequence
  synthetic sequence
gccaagggctcac

SEQ ID NO: 7300 - DNA, 13 bp, Artificial Sequence
  synthetic sequence
cacggcaggggct

SEQ ID NO: 7301 - DNA, 13 bp, Artificial Sequence
  synthetic sequence
gccacctactacc

SEQ ID NO: 7302 - DNA, 13 bp, Artificial Sequence
  synthetic sequence
ccctctgctgcca

SEQ ID NO: 7303 - DNA, 13 bp, Artificial Sequence
  synthetic sequence
gctggaatcagcc

SEQ ID NO: 7304 - DNA, 13 bp, Artificial Sequence
  synthetic sequence
ttgttgctcttcg

SEQ ID NO: 7305 - DNA, 13 bp, Artificial Sequence
  synthetic sequence
aagcaacaaccaa

SEQ ID NO: 7306 - DNA, 13 bp, Artificial Sequence
  synthetic sequence
agtggtacttgag

SEQ ID NO: 7307 - DNA, 13 bp, Artificial Sequence
  synthetic sequence
ttgtgaagtaatc

SEQ ID NO: 7308 - DNA, 13 bp, Artificial Sequence
  synthetic sequence
ctgtctcatgacc

SEQ ID NO: 7309 - DNA, 13 bp, Artificial Sequence
  synthetic sequence
tatcttgatgttc

SEQ ID NO: 7310 - DNA, 13 bp, Artificial Sequence
  synthetic sequence
gagatatctcgcg

SEQ ID NO: 7311 - DNA, 13 bp, Artificial Sequence
  synthetic sequence
gtatgatgtccca

SEQ ID NO: 7312 - DNA, 13 bp, Artificial Sequence
  synthetic sequence
gcatcagtgtggg

SEQ ID NO: 7313 - DNA, 13 bp, Artificial Sequence
  synthetic sequence
gcgaggtactcct

SEQ ID NO: 7314 - DNA, 13 bp, Artificial Sequence
  synthetic sequence
gttgccattgagc

SEQ ID NO: 7315 - DNA, 13 bp, Artificial Sequence
  synthetic sequence
cagtctcaccatg

SEQ ID NO: 7316 - DNA, 13 bp, Artificial Sequence
  synthetic sequence
agctgctcccttc

SEQ ID NO: 7317 - DNA, 13 bp, Artificial Sequence
  synthetic sequence
cctcatcattcag

SEQ ID NO: 7318 - DNA, 13 bp, Artificial Sequence
  synthetic sequence
actggaggatctc

SEQ ID NO: 7319 - DNA, 13 bp, Artificial Sequence
  synthetic sequence
atgttccgaagcc

SEQ ID NO: 7320 - DNA, 13 bp, Artificial Sequence
  synthetic sequence
agtgagttgagtg

SEQ ID NO: 7321 - DNA, 13 bp, Artificial Sequence
  synthetic sequence
atggctctagcag

SEQ ID NO: 7322 - DNA, 13 bp, Artificial Sequence
  synthetic sequence
gcattaaactcta

SEQ ID NO: 7323 - DNA, 13 bp, Artificial Sequence
  synthetic sequence
ccttcttactcca

SEQ ID NO: 7324 - DNA, 13 bp, Artificial Sequence
  synthetic sequence
gaaggaaactatc

SEQ ID NO: 7325 - DNA, 13 bp, Artificial Sequence
  synthetic sequence
gccgagcactagg

SEQ ID NO: 7326 - DNA, 13 bp, Artificial Sequence
  synthetic sequence
atgtgcacccagc

SEQ ID NO: 7327 - DNA, 13 bp, Artificial Sequence
  synthetic sequence
ggttgggtcaatg

SEQ ID NO: 7328 - DNA, 13 bp, Artificial Sequence
  synthetic sequence
caatgagaatccc

SEQ ID NO: 7329 - DNA, 13 bp, Artificial Sequence
  synthetic sequence
gtccatagtttct

SEQ ID NO: 7330 - DNA, 13 bp, Artificial Sequence
  synthetic sequence
atactataactgt

SEQ ID NO: 7331 - DNA, 13 bp, Artificial Sequence
  synthetic sequence
gcaaacatagaaa

SEQ ID NO: 7332 - DNA, 13 bp, Artificial Sequence
  synthetic sequence
gagggtcccaccc

SEQ ID NO: 7333 - DNA, 13 bp, Artificial Sequence
  synthetic sequence
aatatcgttgaag

SEQ ID NO: 7334 - DNA, 13 bp, Artificial Sequence
  synthetic sequence
accactgaggcga

SEQ ID NO: 7335 - DNA, 13 bp, Artificial Sequence
  synthetic sequence
tgattgccaatgt

SEQ ID NO: 7336 - DNA, 13 bp, Artificial Sequence
  synthetic sequence
acatgaacggtgg

SEQ ID NO: 7337 - DNA, 13 bp, Artificial Sequence
  synthetic sequence
cctacgccgcctt

SEQ ID NO: 7338 - DNA, 13 bp, Artificial Sequence
  synthetic sequence
tgaataataaacg

SEQ ID NO: 7339 - DNA, 13 bp, Artificial Sequence
  synthetic sequence
gatggcattgcca

SEQ ID NO: 7340 - DNA, 13 bp, Artificial Sequence
  synthetic sequence
ggcttgcagattt

SEQ ID NO: 7341 - DNA, 13 bp, Artificial Sequence
  synthetic sequence
ggttgatgcgtag

SEQ ID NO: 7342 - DNA, 13 bp, Artificial Sequence
  synthetic sequence
gaacgactgtaag

SEQ ID NO: 7343 - DNA, 13 bp, Artificial Sequence
  synthetic sequence
aatgagcaacaat

SEQ ID NO: 7344 - DNA, 13 bp, Artificial Sequence
  synthetic sequence
acttgctattaat

SEQ ID NO: 7345 - DNA, 13 bp, Artificial Sequence
  synthetic sequence
ccgaatcagcata

SEQ ID NO: 7346 - DNA, 13 bp, Artificial Sequence
  synthetic sequence
tctgcatgtccga

SEQ ID NO: 7347 - DNA, 13 bp, Artificial Sequence
  synthetic sequence
agctctctcgcat

SEQ ID NO: 7348 - DNA, 13 bp, Artificial Sequence
  synthetic sequence
tacggggtataag

SEQ ID NO: 7349 - DNA, 13 bp, Artificial Sequence
  synthetic sequence
ccttataccttac

SEQ ID NO: 7350 - DNA, 13 bp, Artificial Sequence
  synthetic sequence
gacagacacctgt

SEQ ID NO: 7351 - DNA, 13 bp, Artificial Sequence
  synthetic sequence
tctatggtggcaa

SEQ ID NO: 7352 - DNA, 13 bp, Artificial Sequence
  synthetic sequence
tcacccctgtcgt

SEQ ID NO: 7353 - DNA, 13 bp, Artificial Sequence
  synthetic sequence
caccaatggatgg

SEQ ID NO: 7354 - DNA, 13 bp, Artificial Sequence
  synthetic sequence
gtaccgaatcctc

SEQ ID NO: 7355 - DNA, 13 bp, Artificial Sequence
  synthetic sequence
gtagagacaacac

SEQ ID NO: 7356 - DNA, 13 bp, Artificial Sequence
  synthetic sequence
ctgcaaggtaagt

SEQ ID NO: 7357 - DNA, 13 bp, Artificial Sequence
  synthetic sequence
tttcctcaacaaa

SEQ ID NO: 7358 - DNA, 13 bp, Artificial Sequence
  synthetic sequence
gacttctgcaccg

SEQ ID NO: 7359 - DNA, 13 bp, Artificial Sequence
  synthetic sequence
cacaaagacttat

SEQ ID NO: 7360 - DNA, 13 bp, Artificial Sequence
  synthetic sequence
atatacaggacac

SEQ ID NO: 7361 - DNA, 13 bp, Artificial Sequence
  synthetic sequence
ccttctcaaactg

SEQ ID NO: 7362 - DNA, 13 bp, Artificial Sequence
  synthetic sequence
agctcaagttggg

SEQ ID NO: 7363 - DNA, 13 bp, Artificial Sequence
  synthetic sequence
tcttccaaaaggc

SEQ ID NO: 7364 - DNA, 13 bp, Artificial Sequence
  synthetic sequence
ggaagcccaacca

SEQ ID NO: 7365 - DNA, 13 bp, Artificial Sequence
  synthetic sequence
tgacattttccgt

SEQ ID NO: 7366 - DNA, 13 bp, Artificial Sequence
  synthetic sequence
tgtgatagccggt

SEQ ID NO: 7367 - DNA, 13 bp, Artificial Sequence
  synthetic sequence
acttcttctcgcg

SEQ ID NO: 7368 - DNA, 13 bp, Artificial Sequence
  synthetic sequence
gcaagtaatagtc

SEQ ID NO: 7369 - DNA, 13 bp, Artificial Sequence
  synthetic sequence
gctttgctgaaac

SEQ ID NO: 7370 - DNA, 13 bp, Artificial Sequence
  synthetic sequence
agttgcactcgaa

SEQ ID NO: 7371 - DNA, 13 bp, Artificial Sequence
  synthetic sequence
gagggtttttaag

SEQ ID NO: 7372 - DNA, 13 bp, Artificial Sequence
  synthetic sequence
aaccctgcctcga

SEQ ID NO: 7373 - DNA, 13 bp, Artificial Sequence
  synthetic sequence
taagatctgctga

SEQ ID NO: 7374 - DNA, 13 bp, Artificial Sequence
  synthetic sequence
atgcgacatttga

SEQ ID NO: 7375 - DNA, 13 bp, Artificial Sequence
  synthetic sequence
acggtgtattgta

SEQ ID NO: 7376 - DNA, 13 bp, Artificial Sequence
  synthetic sequence
cgagtgtgagctt

SEQ ID NO: 7377 - DNA, 13 bp, Artificial Sequence
  synthetic sequence
tccaactgacgac

SEQ ID NO: 7378 - DNA, 13 bp, Artificial Sequence
  synthetic sequence
gggtcagtcacta

SEQ ID NO: 7379 - DNA, 13 bp, Artificial Sequence
  synthetic sequence
accccctgtgcgt

SEQ ID NO: 7380 - DNA, 13 bp, Artificial Sequence
  synthetic sequence
gttatggccagct

SEQ ID NO: 7381 - DNA, 13 bp, Artificial Sequence
  synthetic sequence
agttgatcctagg

SEQ ID NO: 7382 - DNA, 13 bp, Artificial Sequence
  synthetic sequence
agagctgcttcaa

SEQ ID NO: 7383 - DNA, 13 bp, Artificial Sequence
  synthetic sequence
aaatattgacagg

SEQ ID NO: 7384 - DNA, 13 bp, Artificial Sequence
  synthetic sequence
tcgagaaagagtg

SEQ ID NO: 7385 - DNA, 13 bp, Artificial Sequence
  synthetic sequence
cagccactcagca

SEQ ID NO: 7386 - DNA, 13 bp, Artificial Sequence
  synthetic sequence
acaggcgtcgaca

SEQ ID NO: 7387 - DNA, 13 bp, Artificial Sequence
  synthetic sequence
acgagagtgtcct

SEQ ID NO: 7388 - DNA, 13 bp, Artificial Sequence
  synthetic sequence
gtaaatacggacg

SEQ ID NO: 7389 - DNA, 13 bp, Artificial Sequence
  synthetic sequence
cctcaaggtgagg

SEQ ID NO: 7390 - DNA, 13 bp, Artificial Sequence
  synthetic sequence
tcgaggtagagtt

SEQ ID NO: 7391 - DNA, 13 bp, Artificial Sequence
  synthetic sequence
gctcatcaaattc

SEQ ID NO: 7392 - DNA, 13 bp, Artificial Sequence
  synthetic sequence
tgcacccgcagaa

SEQ ID NO: 7393 - DNA, 13 bp, Artificial Sequence
  synthetic sequence
atcacaggcatat

SEQ ID NO: 7394 - DNA, 13 bp, Artificial Sequence
  synthetic sequence
gcaaatacggacg

SEQ ID NO: 7395 - DNA, 13 bp, Artificial Sequence
  synthetic sequence
agaacgagagtgt

SEQ ID NO: 7396 - DNA, 13 bp, Artificial Sequence
  synthetic sequence
agcggtgtgtaag

SEQ ID NO: 7397 - DNA, 13 bp, Artificial Sequence
  synthetic sequence
ttattagatagag

SEQ ID NO: 7398 - DNA, 13 bp, Artificial Sequence
  synthetic sequence
tttgcgagatggc

SEQ ID NO: 7399 - DNA, 13 bp, Artificial Sequence
  synthetic sequence
acgtggattgcag

SEQ ID NO: 7400 - DNA, 13 bp, Artificial Sequence
  synthetic sequence
cgatcaggcgctg

SEQ ID NO: 7401 - DNA, 13 bp, Artificial Sequence
  synthetic sequence
ttttacaacaact

SEQ ID NO: 7402 - DNA, 13 bp, Artificial Sequence
  synthetic sequence
ttgaaatttcagg

SEQ ID NO: 7403 - DNA, 13 bp, Artificial Sequence
  synthetic sequence
atcctgggtgtcg

SEQ ID NO: 7404 - DNA, 13 bp, Artificial Sequence
  synthetic sequence
acctggagcggaa

SEQ ID NO: 7405 - DNA, 13 bp, Artificial Sequence
  synthetic sequence
gtttgttttccga

SEQ ID NO: 7406 - DNA, 13 bp, Artificial Sequence
  synthetic sequence
atcctcaagattt

SEQ ID NO: 7407 - DNA, 13 bp, Artificial Sequence
  synthetic sequence
ctagagatgatgg

SEQ ID NO: 7408 - DNA, 13 bp, Artificial Sequence
  synthetic sequence
tacggagttggga

SEQ ID NO: 7409 - DNA, 13 bp, Artificial Sequence
  synthetic sequence
gtgggcttgcagt

SEQ ID NO: 7410 - DNA, 13 bp, Artificial Sequence
  synthetic sequence
ttatgtatgccct

SEQ ID NO: 7411 - DNA, 13 bp, Artificial Sequence
  synthetic sequence
tcagattgtgttc

SEQ ID NO: 7412 - DNA, 13 bp, Artificial Sequence
  synthetic sequence
gattccttcgaac

SEQ ID NO: 7413 - DNA, 13 bp, Artificial Sequence
  synthetic sequence
tttatccagtcat

SEQ ID NO: 7414 - DNA, 13 bp, Artificial Sequence
  synthetic sequence
catctctatcttt

SEQ ID NO: 7415 - DNA, 13 bp, Artificial Sequence
  synthetic sequence
agatggctgcaag

SEQ ID NO: 7416 - DNA, 13 bp, Artificial Sequence
  synthetic sequence
tattgtgagatga

SEQ ID NO: 7417 - DNA, 13 bp, Artificial Sequence
  synthetic sequence
aagaagttatttt

SEQ ID NO: 7418 - DNA, 13 bp, Artificial Sequence
  synthetic sequence
aatagcaagtaat

SEQ ID NO: 7419 - DNA, 13 bp, Artificial Sequence
  synthetic sequence
tgtcattaaggcg

SEQ ID NO: 7420 - DNA, 13 bp, Artificial Sequence
  synthetic sequence
tttactgatggtt

SEQ ID NO: 7421 - DNA, 13 bp, Artificial Sequence
  synthetic sequence
gtattgcacaatg

SEQ ID NO: 7422 - DNA, 13 bp, Artificial Sequence
  synthetic sequence
gcggccaaccatt

SEQ ID NO: 7423 - DNA, 13 bp, Artificial Sequence
  synthetic sequence
aagggagtgcttg

SEQ ID NO: 7424 - DNA, 13 bp, Artificial Sequence
  synthetic sequence
tgtcaagcagaca

SEQ ID NO: 7425 - DNA, 13 bp, Artificial Sequence
  synthetic sequence
agtatgaggagca

SEQ ID NO: 7426 - DNA, 13 bp, Artificial Sequence
  synthetic sequence
tgtgactatgttg

SEQ ID NO: 7427 - DNA, 13 bp, Artificial Sequence
  synthetic sequence
aagacatttctgt

SEQ ID NO: 7428 - DNA, 13 bp, Artificial Sequence
  synthetic sequence
cagagtacacgga

SEQ ID NO: 7429 - DNA, 13 bp, Artificial Sequence
  synthetic sequence
agtggactggtac

SEQ ID NO: 7430 - DNA, 13 bp, Artificial Sequence
  synthetic sequence
gggagaggttctc

SEQ ID NO: 7431 - DNA, 13 bp, Artificial Sequence
  synthetic sequence
gacaatgatccat

SEQ ID NO: 7432 - DNA, 13 bp, Artificial Sequence
  synthetic sequence
ttatgaagttgag

SEQ ID NO: 7433 - DNA, 13 bp, Artificial Sequence
  synthetic sequence
gataattgggatc

SEQ ID NO: 7434 - DNA, 13 bp, Artificial Sequence
  synthetic sequence
catccgttgcatg

SEQ ID NO: 7435 - DNA, 13 bp, Artificial Sequence
  synthetic sequence
ggaaaattgctgg

SEQ ID NO: 7436 - DNA, 13 bp, Artificial Sequence
  synthetic sequence
ggtgtctaatttt

SEQ ID NO: 7437 - DNA, 13 bp, Artificial Sequence
  synthetic sequence
ttagcgggacaag

SEQ ID NO: 7438 - DNA, 13 bp, Artificial Sequence
  synthetic sequence
aaagagtgtttgt

SEQ ID NO: 7439 - DNA, 13 bp, Artificial Sequence
  synthetic sequence
cgagaacacggta

SEQ ID NO: 7440 - DNA, 13 bp, Artificial Sequence
  synthetic sequence
cttcctcttgatc

SEQ ID NO: 7441 - DNA, 13 bp, Artificial Sequence
  synthetic sequence
cctcctcccaaga

SEQ ID NO: 7442 - DNA, 13 bp, Artificial Sequence
  synthetic sequence
ccttgacaaaaag

SEQ ID NO: 7443 - DNA, 13 bp, Artificial Sequence
  synthetic sequence
aggcaaactttac

SEQ ID NO: 7444 - DNA, 13 bp, Artificial Sequence
  synthetic sequence
ataaggcaaagga

SEQ ID NO: 7445 - DNA, 13 bp, Artificial Sequence
  synthetic sequence
ccgaggtaaatcg

SEQ ID NO: 7446 - DNA, 13 bp, Artificial Sequence
  synthetic sequence
tctcacgcatgtc

SEQ ID NO: 7447 - DNA, 13 bp, Artificial Sequence
  synthetic sequence
tcttccgccggtg

SEQ ID NO: 7448 - DNA, 13 bp, Artificial Sequence
  synthetic sequence
gaactccaagcgc

SEQ ID NO: 7449 - DNA, 13 bp, Artificial Sequence
  synthetic sequence
ttcttcgcaaaaa

SEQ ID NO: 7450 - DNA, 13 bp, Artificial Sequence
  synthetic sequence
gaaaaggcttcgt

SEQ ID NO: 7451 - DNA, 13 bp, Artificial Sequence
  synthetic sequence
gtttttatcataa

SEQ ID NO: 7452 - DNA, 13 bp, Artificial Sequence
  synthetic sequence
gcttgccatacca

SEQ ID NO: 7453 - DNA, 13 bp, Artificial Sequence
  synthetic sequence
tagcccgttaatt

SEQ ID NO: 7454 - DNA, 13 bp, Artificial Sequence
  synthetic sequence
cactttctcaagt

SEQ ID NO: 7455 - DNA, 13 bp, Artificial Sequence
  synthetic sequence
aaaccatcagcgc

SEQ ID NO: 7456 - DNA, 13 bp, Artificial Sequence
  synthetic sequence
ccactactgaatt

SEQ ID NO: 7457 - DNA, 13 bp, Artificial Sequence
  synthetic sequence
accaaccatctgt

SEQ ID NO: 7458 - DNA, 13 bp, Artificial Sequence
  synthetic sequence
cccagaattcttg

SEQ ID NO: 7459 - DNA, 13 bp, Artificial Sequence
  synthetic sequence
acatattcaatgt

SEQ ID NO: 7460 - DNA, 13 bp, Artificial Sequence
  synthetic sequence
tctagcaatcgtg

SEQ ID NO: 7461 - DNA, 13 bp, Artificial Sequence
  synthetic sequence
cagggttattcaa

SEQ ID NO: 7462 - DNA, 13 bp, Artificial Sequence
  synthetic sequence
tctttcacattac

SEQ ID NO: 7463 - DNA, 13 bp, Artificial Sequence
  synthetic sequence
gcattcttggatg

SEQ ID NO: 7464 - DNA, 13 bp, Artificial Sequence
  synthetic sequence
cactctttataga

SEQ ID NO: 7465 - DNA, 13 bp, Artificial Sequence
  synthetic sequence
agtaatatgaatt

SEQ ID NO: 7466 - DNA, 13 bp, Artificial Sequence
  synthetic sequence
ctgacgcaaaatg

SEQ ID NO: 7467 - DNA, 13 bp, Artificial Sequence
  synthetic sequence
cgttctgcgtctg

SEQ ID NO: 7468 - DNA, 13 bp, Artificial Sequence
  synthetic sequence
caaacaagccaaa

SEQ ID NO: 7469 - DNA, 13 bp, Artificial Sequence
  synthetic sequence
tcaagtgcatcat

SEQ ID NO: 7470 - DNA, 13 bp, Artificial Sequence
  synthetic sequence
ccgcagtatttaa

SEQ ID NO: 7471 - DNA, 13 bp, Artificial Sequence
  synthetic sequence
tcaaggatacgtg

SEQ ID NO: 7472 - DNA, 13 bp, Artificial Sequence
  synthetic sequence
ctcataacctaac

SEQ ID NO: 7473 - DNA, 13 bp, Artificial Sequence
  synthetic sequence
aacatccattaaa

SEQ ID NO: 7474 - DNA, 13 bp, Artificial Sequence
  synthetic sequence
tctttagatacaa

SEQ ID NO: 7475 - DNA, 13 bp, Artificial Sequence
  synthetic sequence
ctacataattatc

SEQ ID NO: 7476 - DNA, 13 bp, Artificial Sequence
  synthetic sequence
ctcaacgataaat

SEQ ID NO: 7477 - DNA, 13 bp, Artificial Sequence
  synthetic sequence
cgctcccagcaat

SEQ ID NO: 7478 - DNA, 13 bp, Artificial Sequence
  synthetic sequence
agcttaatgtccc

SEQ ID NO: 7479 - DNA, 13 bp, Artificial Sequence
  synthetic sequence
cttttcatgcaac

SEQ ID NO: 7480 - DNA, 13 bp, Artificial Sequence
  synthetic sequence
ttctaccagtccg

SEQ ID NO: 7481 - DNA, 13 bp, Artificial Sequence
  synthetic sequence
tcatggattgcgc

SEQ ID NO: 7482 - DNA, 13 bp, Artificial Sequence
  synthetic sequence
ccatatcacctct

SEQ ID NO: 7483 - DNA, 13 bp, Artificial Sequence
  synthetic sequence
aatacctaaagta

SEQ ID NO: 7484 - DNA, 13 bp, Artificial Sequence
  synthetic sequence
cctcctcccaaga

SEQ ID NO: 7485 - DNA, 13 bp, Artificial Sequence
  synthetic sequence
ccttgacaaaaag

SEQ ID NO: 7486 - DNA, 13 bp, Artificial Sequence
  synthetic sequence
aggcaaactttac

SEQ ID NO: 7487 - DNA, 13 bp, Artificial Sequence
  synthetic sequence
ataaggcaaagga

SEQ ID NO: 7488 - DNA, 13 bp, Artificial Sequence
  synthetic sequence
ccgaggtaaatcg

SEQ ID NO: 7489 - DNA, 13 bp, Artificial Sequence
  synthetic sequence
tctcacgcatgtc

SEQ ID NO: 7490 - DNA, 13 bp, Artificial Sequence
  synthetic sequence
tcttccgccggtg

SEQ ID NO: 7491 - DNA, 13 bp, Artificial Sequence
  synthetic sequence
gaactccaagcgc

SEQ ID NO: 7492 - DNA, 13 bp, Artificial Sequence
  synthetic sequence
ttcttcgcaaaaa

SEQ ID NO: 7493 - DNA, 13 bp, Artificial Sequence
  synthetic sequence
gaaaaggcttcgt

SEQ ID NO: 7494 - DNA, 13 bp, Artificial Sequence
  synthetic sequence
gtttttatcataa

SEQ ID NO: 7495 - DNA, 13 bp, Artificial Sequence
  synthetic sequence
gcttgccatacca

SEQ ID NO: 7496 - DNA, 13 bp, Artificial Sequence
  synthetic sequence
tagcccgttaatt

SEQ ID NO: 7497 - DNA, 13 bp, Artificial Sequence
  synthetic sequence
cactttctcaagt

SEQ ID NO: 7498 - DNA, 13 bp, Artificial Sequence
  synthetic sequence
aaaccatcagcgc

SEQ ID NO: 7499 - DNA, 13 bp, Artificial Sequence
  synthetic sequence
ccactactgaatt

SEQ ID NO: 7500 - DNA, 13 bp, Artificial Sequence
  synthetic sequence
accaaccatctgt

SEQ ID NO: 7501 - DNA, 13 bp, Artificial Sequence
  synthetic sequence
cccagaattcttg

SEQ ID NO: 7502 - DNA, 13 bp, Artificial Sequence
  synthetic sequence
acatattcaatgt

SEQ ID NO: 7503 - DNA, 13 bp, Artificial Sequence
  synthetic sequence
tctagcaatcgtg

SEQ ID NO: 7504 - DNA, 13 bp, Artificial Sequence
  synthetic sequence
cagggttattcaa

SEQ ID NO: 7505 - DNA, 13 bp, Artificial Sequence
  synthetic sequence
tctttcacattac

SEQ ID NO: 7506 - DNA, 13 bp, Artificial Sequence
  synthetic sequence
gcattcttggatg

SEQ ID NO: 7507 - DNA, 13 bp, Artificial Sequence
  synthetic sequence
cactctttataga

SEQ ID NO: 7508 - DNA, 13 bp, Artificial Sequence
  synthetic sequence
agtaatatgaatt

SEQ ID NO: 7509 - DNA, 13 bp, Artificial Sequence
  synthetic sequence
ctgacgcaaaatg

SEQ ID NO: 7510 - DNA, 13 bp, Artificial Sequence
  synthetic sequence
cgttctgcgtctg

SEQ ID NO: 7511 - DNA, 13 bp, Artificial Sequence
  synthetic sequence
caaacaagccaaa

SEQ ID NO: 7512 - DNA, 13 bp, Artificial Sequence
  synthetic sequence
tcaagtgcatcat

SEQ ID NO: 7513 - DNA, 13 bp, Artificial Sequence
  synthetic sequence
ccgcagtatttaa

SEQ ID NO: 7514 - DNA, 13 bp, Artificial Sequence
  synthetic sequence
tcaaggatacgtg

SEQ ID NO: 7515 - DNA, 13 bp, Artificial Sequence
  synthetic sequence
ctcataacctaac

SEQ ID NO: 7516 - DNA, 13 bp, Artificial Sequence
  synthetic sequence
aacatccattaaa

SEQ ID NO: 7517 - DNA, 13 bp, Artificial Sequence
  synthetic sequence
tctttagatacaa

SEQ ID NO: 7518 - DNA, 13 bp, Artificial Sequence
  synthetic sequence
ctacataattatc

SEQ ID NO: 7519 - DNA, 13 bp, Artificial Sequence
  synthetic sequence
ctcaacgataaat

SEQ ID NO: 7520 - DNA, 13 bp, Artificial Sequence
  synthetic sequence
cgctcccagcaat

SEQ ID NO: 7521 - DNA, 13 bp, Artificial Sequence
  synthetic sequence
agcttaatgtccc

SEQ ID NO: 7522 - DNA, 13 bp, Artificial Sequence
  synthetic sequence
cttttcatgcaac

SEQ ID NO: 7523 - DNA, 13 bp, Artificial Sequence
  synthetic sequence
ttctaccagtccg

SEQ ID NO: 7524 - DNA, 13 bp, Artificial Sequence
  synthetic sequence
tcatggattgcgc

SEQ ID NO: 7525 - DNA, 13 bp, Artificial Sequence
  synthetic sequence
ccatatcacctct

SEQ ID NO: 7526 - DNA, 13 bp, Artificial Sequence
  synthetic sequence
aatacctaaagta

SEQ ID NO: 7527 - DNA, 13 bp, Artificial Sequence
  synthetic sequence
cctcctcccaaga

SEQ ID NO: 7528 - DNA, 13 bp, Artificial Sequence
  synthetic sequence
ccttgacaaaaag

SEQ ID NO: 7529 - DNA, 13 bp, Artificial Sequence
  synthetic sequence
aggcaaactttac

SEQ ID NO: 7530 - DNA, 13 bp, Artificial Sequence
  synthetic sequence
ataaggcaaagga

SEQ ID NO: 7531 - DNA, 13 bp, Artificial Sequence
  synthetic sequence
ccgaggtaaatcg

SEQ ID NO: 7532 - DNA, 13 bp, Artificial Sequence
  synthetic sequence
tctcacgcatgtc

SEQ ID NO: 7533 - DNA, 13 bp, Artificial Sequence
  synthetic sequence
tcttccgccggtg

SEQ ID NO: 7534 - DNA, 13 bp, Artificial Sequence
  synthetic sequence
gaactccaagcgc

SEQ ID NO: 7535 - DNA, 13 bp, Artificial Sequence
  synthetic sequence
ttcttcgcaaaaa

SEQ ID NO: 7536 - DNA, 13 bp, Artificial Sequence
  synthetic sequence
gaaaaggcttcgt

SEQ ID NO: 7537 - DNA, 13 bp, Artificial Sequence
  synthetic sequence
gtttttatcataa

SEQ ID NO: 7538 - DNA, 13 bp, Artificial Sequence
  synthetic sequence
gcttgccatacca

SEQ ID NO: 7539 - DNA, 13 bp, Artificial Sequence
  synthetic sequence
tagcccgttaatt

SEQ ID NO: 7540 - DNA, 13 bp, Artificial Sequence
  synthetic sequence
cactttctcaagt

SEQ ID NO: 7541 - DNA, 13 bp, Artificial Sequence
  synthetic sequence
aaaccatcagcgc

SEQ ID NO: 7542 - DNA, 13 bp, Artificial Sequence
  synthetic sequence
ccactactgaatt

SEQ ID NO: 7543 - DNA, 13 bp, Artificial Sequence
  synthetic sequence
accaaccatctgt

SEQ ID NO: 7544 - DNA, 13 bp, Artificial Sequence
  synthetic sequence
cccagaattcttg

SEQ ID NO: 7545 - DNA, 13 bp, Artificial Sequence
  synthetic sequence
acatattcaatgt

SEQ ID NO: 7546 - DNA, 13 bp, Artificial Sequence
  synthetic sequence
tctagcaatcgtg

SEQ ID NO: 7547 - DNA, 13 bp, Artificial Sequence
  synthetic sequence
cagggttattcaa

SEQ ID NO: 7548 - DNA, 13 bp, Artificial Sequence
  synthetic sequence
tctttcacattac

SEQ ID NO: 7549 - DNA, 13 bp, Artificial Sequence
  synthetic sequence
gcattcttggatg

SEQ ID NO: 7550 - DNA, 13 bp, Artificial Sequence
  synthetic sequence
cactctttataga

SEQ ID NO: 7551 - DNA, 13 bp, Artificial Sequence
  synthetic sequence
agtaatatgaatt

SEQ ID NO: 7552 - DNA, 13 bp, Artificial Sequence
  synthetic sequence
ctgacgcaaaatg

SEQ ID NO: 7553 - DNA, 13 bp, Artificial Sequence
  synthetic sequence
cgttctgcgtctg

SEQ ID NO: 7554 - DNA, 13 bp, Artificial Sequence
  synthetic sequence
caaacaagccaaa

SEQ ID NO: 7555 - DNA, 13 bp, Artificial Sequence
  synthetic sequence
tcaagtgcatcat

SEQ ID NO: 7556 - DNA, 13 bp, Artificial Sequence
  synthetic sequence
ccgcagtatttaa

SEQ ID NO: 7557 - DNA, 13 bp, Artificial Sequence
  synthetic sequence
tcaaggatacgtg

SEQ ID NO: 7558 - DNA, 13 bp, Artificial Sequence
  synthetic sequence
ctcataacctaac

SEQ ID NO: 7559 - DNA, 13 bp, Artificial Sequence
  synthetic sequence
aacatccattaaa

SEQ ID NO: 7560 - DNA, 13 bp, Artificial Sequence
  synthetic sequence
tctttagatacaa

SEQ ID NO: 7561 - DNA, 13 bp, Artificial Sequence
  synthetic sequence
ctacataattatc

SEQ ID NO: 7562 - DNA, 13 bp, Artificial Sequence
  synthetic sequence
ctcaacgataaat

SEQ ID NO: 7563 - DNA, 13 bp, Artificial Sequence
  synthetic sequence
cgctcccagcaat

SEQ ID NO: 7564 - DNA, 13 bp, Artificial Sequence
  synthetic sequence
agcttaatgtccc

SEQ ID NO: 7565 - DNA, 13 bp, Artificial Sequence
  synthetic sequence
cttttcatgcaac

SEQ ID NO: 7566 - DNA, 13 bp, Artificial Sequence
  synthetic sequence
ttctaccagtccg

SEQ ID NO: 7567 - DNA, 13 bp, Artificial Sequence
  synthetic sequence
tcatggattgcgc

SEQ ID NO: 7568 - DNA, 13 bp, Artificial Sequence
  synthetic sequence
ccatatcacctct

SEQ ID NO: 7569 - DNA, 13 bp, Artificial Sequence
  synthetic sequence
aatacctaaagta

SEQ ID NO: 7570 - DNA, 13 bp, Artificial Sequence
  synthetic sequence
atcttgcgttaca

SEQ ID NO: 7571 - DNA, 13 bp, Artificial Sequence
  synthetic sequence
ggccagagccggg

SEQ ID NO: 7572 - DNA, 13 bp, Artificial Sequence
  synthetic sequence
caaagcaccccaa

SEQ ID NO: 7573 - DNA, 13 bp, Artificial Sequence
  synthetic sequence
ttgtaagacaatc

SEQ ID NO: 7574 - DNA, 13 bp, Artificial Sequence
  synthetic sequence
agcccagaggctc

SEQ ID NO: 7575 - DNA, 13 bp, Artificial Sequence
  synthetic sequence
ccacatgtccccc

SEQ ID NO: 7576 - DNA, 13 bp, Artificial Sequence
  synthetic sequence
tcaccaactcctg

SEQ ID NO: 7577 - DNA, 13 bp, Artificial Sequence
  synthetic sequence
gagaccagagcca

SEQ ID NO: 7578 - DNA, 13 bp, Artificial Sequence
  synthetic sequence
gacacaagagcca

SEQ ID NO: 7579 - DNA, 13 bp, Artificial Sequence
  synthetic sequence
atccctaccagga

SEQ ID NO: 7580 - DNA, 13 bp, Artificial Sequence
  synthetic sequence
cagcagcaccagc

SEQ ID NO: 7581 - DNA, 13 bp, Artificial Sequence
  synthetic sequence
actacaaaggcct

SEQ ID NO: 7582 - DNA, 13 bp, Artificial Sequence
  synthetic sequence
ccacctgcaacac

SEQ ID NO: 7583 - DNA, 13 bp, Artificial Sequence
  synthetic sequence
caataggaagagc

SEQ ID NO: 7584 - DNA, 13 bp, Artificial Sequence
  synthetic sequence
atcttgcgttaca

SEQ ID NO: 7585 - DNA, 13 bp, Artificial Sequence
  synthetic sequence
ggccagagccggg

SEQ ID NO: 7586 - DNA, 13 bp, Artificial Sequence
  synthetic sequence
caaagcaccccaa

SEQ ID NO: 7587 - DNA, 13 bp, Artificial Sequence
  synthetic sequence
ttgtaagacaatc

SEQ ID NO: 7588 - DNA, 13 bp, Artificial Sequence
  synthetic sequence
agcccagaggctc

SEQ ID NO: 7589 - DNA, 13 bp, Artificial Sequence
  synthetic sequence
ccacatgtccccc

SEQ ID NO: 7590 - DNA, 13 bp, Artificial Sequence
  synthetic sequence
tcaccaactcctg

SEQ ID NO: 7591 - DNA, 13 bp, Artificial Sequence
  synthetic sequence
gagaccagagcca

SEQ ID NO: 7592 - DNA, 13 bp, Artificial Sequence
  synthetic sequence
gacacaagagcca

SEQ ID NO: 7593 - DNA, 13 bp, Artificial Sequence
  synthetic sequence
atccctaccagga

SEQ ID NO: 7594 - DNA, 13 bp, Artificial Sequence
  synthetic sequence
cagcagcaccagc

SEQ ID NO: 7595 - DNA, 13 bp, Artificial Sequence
  synthetic sequence
actacaaaggcct

SEQ ID NO: 7596 - DNA, 13 bp, Artificial Sequence
  synthetic sequence
ccacctgcaacac

SEQ ID NO: 7597 - DNA, 13 bp, Artificial Sequence
  synthetic sequence
caataggaagagc

SEQ ID NO: 7598 - DNA, 13 bp, Artificial Sequence
  synthetic sequence
ggcgaggtctttt

SEQ ID NO: 7599 - DNA, 13 bp, Artificial Sequence
  synthetic sequence
tctaagtctgcgg

SEQ ID NO: 7600 - DNA, 13 bp, Artificial Sequence
  synthetic sequence
tgcaagacaggga

SEQ ID NO: 7601 - DNA, 13 bp, Artificial Sequence
  synthetic sequence
gccccgagggtag

SEQ ID NO: 7602 - DNA, 13 bp, Artificial Sequence
  synthetic sequence
agtggttgtggag

SEQ ID NO: 7603 - DNA, 13 bp, Artificial Sequence
  synthetic sequence
ggtccatgcccga

SEQ ID NO: 7604 - DNA, 13 bp, Artificial Sequence
  synthetic sequence
ttgtgggccttgt

SEQ ID NO: 7605 - DNA, 13 bp, Artificial Sequence
  synthetic sequence
ggttcatgtattg

SEQ ID NO: 7606 - DNA, 13 bp, Artificial Sequence
  synthetic sequence
gaccgaggactgg

SEQ ID NO: 7607 - DNA, 13 bp, Artificial Sequence
  synthetic sequence
cataggtggaatg

SEQ ID NO: 7608 - DNA, 13 bp, Artificial Sequence
  synthetic sequence
gtagtggtgtggg

SEQ ID NO: 7609 - DNA, 13 bp, Artificial Sequence
  synthetic sequence
acccccgtgtttt

SEQ ID NO: 7610 - DNA, 13 bp, Artificial Sequence
  synthetic sequence
atgttcccatacc

SEQ ID NO: 7611 - DNA, 13 bp, Artificial Sequence
  synthetic sequence
tggccgcacgaag

SEQ ID NO: 7612 - DNA, 13 bp, Artificial Sequence
  synthetic sequence
gacaccttgcaag

SEQ ID NO: 7613 - DNA, 13 bp, Artificial Sequence
  synthetic sequence
gataccctccagt

SEQ ID NO: 7614 - DNA, 13 bp, Artificial Sequence
  synthetic sequence
acttgcagcgctt

SEQ ID NO: 7615 - DNA, 13 bp, Artificial Sequence
  synthetic sequence
gtgcacagttgcc

SEQ ID NO: 7616 - DNA, 13 bp, Artificial Sequence
  synthetic sequence
gagcgtcagctgg

SEQ ID NO: 7617 - DNA, 13 bp, Artificial Sequence
  synthetic sequence
cacacagcagtga

SEQ ID NO: 7618 - DNA, 13 bp, Artificial Sequence
  synthetic sequence
cagtcaccggaga

SEQ ID NO: 7619 - DNA, 13 bp, Artificial Sequence
  synthetic sequence
cgctcggaagagt

SEQ ID NO: 7620 - DNA, 13 bp, Artificial Sequence
  synthetic sequence
ccaaggtgaaaat

SEQ ID NO: 7621 - DNA, 13 bp, Artificial Sequence
  synthetic sequence
cgacagcgaatgt

SEQ ID NO: 7622 - DNA, 13 bp, Artificial Sequence
  synthetic sequence
accctgattttac

SEQ ID NO: 7623 - DNA, 13 bp, Artificial Sequence
  synthetic sequence
ttcgaacgatgga

SEQ ID NO: 7624 - DNA, 13 bp, Artificial Sequence
  synthetic sequence
ctatcagtggtga

SEQ ID NO: 7625 - DNA, 13 bp, Artificial Sequence
  synthetic sequence
cacaagcgtgcag

SEQ ID NO: 7626 - DNA, 13 bp, Artificial Sequence
  synthetic sequence
gaagacggatgga

SEQ ID NO: 7627 - DNA, 13 bp, Artificial Sequence
  synthetic sequence
tgcaggtctgcac

SEQ ID NO: 7628 - DNA, 13 bp, Artificial Sequence
  synthetic sequence
agatcgacaacct

SEQ ID NO: 7629 - DNA, 13 bp, Artificial Sequence
  synthetic sequence
acggatgtcaaac

SEQ ID NO: 7630 - DNA, 13 bp, Artificial Sequence
  synthetic sequence
caaccaccctgca

SEQ ID NO: 7631 - DNA, 13 bp, Artificial Sequence
  synthetic sequence
acgtcggcgatat

SEQ ID NO: 7632 - DNA, 13 bp, Artificial Sequence
  synthetic sequence
tggctcctttgca

SEQ ID NO: 7633 - DNA, 13 bp, Artificial Sequence
  synthetic sequence
agcgggagaccta

SEQ ID NO: 7634 - DNA, 13 bp, Artificial Sequence
  synthetic sequence
agttattaaagag

SEQ ID NO: 7635 - DNA, 13 bp, Artificial Sequence
  synthetic sequence
aaaattacggagt

SEQ ID NO: 7636 - DNA, 13 bp, Artificial Sequence
  synthetic sequence
caccacttgcagc

SEQ ID NO: 7637 - DNA, 13 bp, Artificial Sequence
  synthetic sequence
acctgcaatcacg

SEQ ID NO: 7638 - DNA, 13 bp, Artificial Sequence
  synthetic sequence
tgccgctgtgaaa

SEQ ID NO: 7639 - DNA, 13 bp, Artificial Sequence
  synthetic sequence
cctgactatcagt

SEQ ID NO: 7640 - DNA, 13 bp, Artificial Sequence
  synthetic sequence
tggttaataccag

SEQ ID NO: 7641 - DNA, 13 bp, Artificial Sequence
  synthetic sequence
gtagaaggcagaa

SEQ ID NO: 7642 - DNA, 13 bp, Artificial Sequence
  synthetic sequence
ataacaaggtggt

SEQ ID NO: 7643 - DNA, 13 bp, Artificial Sequence
  synthetic sequence
ccctatatctata

SEQ ID NO: 7644 - DNA, 13 bp, Artificial Sequence
  synthetic sequence
agggcgacacttt

SEQ ID NO: 7645 - DNA, 13 bp, Artificial Sequence
  synthetic sequence
tggcacgcccgta

SEQ ID NO: 7646 - DNA, 13 bp, Artificial Sequence
  synthetic sequence
aagaagcctgcgc

SEQ ID NO: 7647 - DNA, 13 bp, Artificial Sequence
  synthetic sequence
attgccctaactg

SEQ ID NO: 7648 - DNA, 13 bp, Artificial Sequence
  synthetic sequence
aattgtgcagtgg

SEQ ID NO: 7649 - DNA, 13 bp, Artificial Sequence
  synthetic sequence
aacttcatgtgcc

SEQ ID NO: 7650 - DNA, 13 bp, Artificial Sequence
  synthetic sequence
ttcgataataagg

SEQ ID NO: 7651 - DNA, 13 bp, Artificial Sequence
  synthetic sequence
caaccactgctgt

SEQ ID NO: 7652 - DNA, 13 bp, Artificial Sequence
  synthetic sequence
cgtctgcatccag

SEQ ID NO: 7653 - DNA, 13 bp, Artificial Sequence
  synthetic sequence
gttcggggctagt

SEQ ID NO: 7654 - DNA, 13 bp, Artificial Sequence
  synthetic sequence
tccacccaggaca

SEQ ID NO: 7655 - DNA, 13 bp, Artificial Sequence
  synthetic sequence
ggcgccgcagaca

SEQ ID NO: 7656 - DNA, 13 bp, Artificial Sequence
  synthetic sequence
agtgcctgtgtgt

SEQ ID NO: 7657 - DNA, 13 bp, Artificial Sequence
  synthetic sequence
aggctcctcccca

SEQ ID NO: 7658 - DNA, 13 bp, Artificial Sequence
  synthetic sequence
cttctatagctat

SEQ ID NO: 7659 - DNA, 13 bp, Artificial Sequence
  synthetic sequence
ggaatgtaaatga

SEQ ID NO: 7660 - DNA, 13 bp, Artificial Sequence
  synthetic sequence
ggccttcttcagc

SEQ ID NO: 7661 - DNA, 13 bp, Artificial Sequence
  synthetic sequence
cctgactcttgag

SEQ ID NO: 7662 - DNA, 13 bp, Artificial Sequence
  synthetic sequence
ctcatgtaggcca

SEQ ID NO: 7663 - DNA, 13 bp, Artificial Sequence
  synthetic sequence
ccaaacggggcta

SEQ ID NO: 7664 - DNA, 13 bp, Artificial Sequence
  synthetic sequence
atgaattggacag

SEQ ID NO: 7665 - DNA, 13 bp, Artificial Sequence
  synthetic sequence
ttcttttcataac

SEQ ID NO: 7666 - DNA, 13 bp, Artificial Sequence
  synthetic sequence
ggcctgaattcta

SEQ ID NO: 7667 - DNA, 13 bp, Artificial Sequence
  synthetic sequence
ggcagtcttccag

SEQ ID NO: 7668 - DNA, 13 bp, Artificial Sequence
  synthetic sequence
ctattttcgcggg

SEQ ID NO: 7669 - DNA, 13 bp, Artificial Sequence
  synthetic sequence
tggtcggcaacta

SEQ ID NO: 7670 - DNA, 13 bp, Artificial Sequence
  synthetic sequence
tggggtcgttgta

SEQ ID NO: 7671 - DNA, 13 bp, Artificial Sequence
  synthetic sequence
atttcactactgg

SEQ ID NO: 7672 - DNA, 13 bp, Artificial Sequence
  synthetic sequence
atagccacacagg

SEQ ID NO: 7673 - DNA, 13 bp, Artificial Sequence
  synthetic sequence
agtagtatttcac

SEQ ID NO: 7674 - DNA, 13 bp, Artificial Sequence
  synthetic sequence
tatgttgtgctgg

SEQ ID NO: 7675 - DNA, 13 bp, Artificial Sequence
  synthetic sequence
ctgctttgccggt

SEQ ID NO: 7676 - DNA, 13 bp, Artificial Sequence
  synthetic sequence
ctggtgtatcttt

SEQ ID NO: 7677 - DNA, 13 bp, Artificial Sequence
  synthetic sequence
tttcagatattct

SEQ ID NO: 7678 - DNA, 13 bp, Artificial Sequence
  synthetic sequence
gctgtatctgtag

SEQ ID NO: 7679 - DNA, 13 bp, Artificial Sequence
  synthetic sequence
tgtttcaaagtca

SEQ ID NO: 7680 - DNA, 13 bp, Artificial Sequence
  synthetic sequence
tgttctcatactg

SEQ ID NO: 7681 - DNA, 13 bp, Artificial Sequence
  synthetic sequence
tcctggttctcct

SEQ ID NO: 7682 - DNA, 13 bp, Artificial Sequence
  synthetic sequence
tgtcgagttggat

SEQ ID NO: 7683 - DNA, 13 bp, Artificial Sequence
  synthetic sequence
tgtcccctggtgg

SEQ ID NO: 7684 - DNA, 13 bp, Artificial Sequence
  synthetic sequence
cccacgacgcacg

SEQ ID NO: 7685 - DNA, 13 bp, Artificial Sequence
  synthetic sequence
ggtgccagcgtgg

SEQ ID NO: 7686 - DNA, 13 bp, Artificial Sequence
  synthetic sequence
ccactgccgtagc

SEQ ID NO: 7687 - DNA, 13 bp, Artificial Sequence
  synthetic sequence
cacagctccatga

SEQ ID NO: 7688 - DNA, 13 bp, Artificial Sequence
  synthetic sequence
ccggtgccagtgt

SEQ ID NO: 7689 - DNA, 13 bp, Artificial Sequence
  synthetic sequence
ctcaatccattgt

SEQ ID NO: 7690 - DNA, 13 bp, Artificial Sequence
  synthetic sequence
tgtaatagccgtg

SEQ ID NO: 7691 - DNA, 13 bp, Artificial Sequence
  synthetic sequence
gcatgcgtaacca

SEQ ID NO: 7692 - DNA, 13 bp, Artificial Sequence
  synthetic sequence
gagtgtccaaatc

SEQ ID NO: 7693 - DNA, 13 bp, Artificial Sequence
  synthetic sequence
ggataatcgacga

SEQ ID NO: 7694 - DNA, 13 bp, Artificial Sequence
  synthetic sequence
ggtgctcgttgtt

SEQ ID NO: 7695 - DNA, 13 bp, Artificial Sequence
  synthetic sequence
agcctgtgggttg

SEQ ID NO: 7696 - DNA, 13 bp, Artificial Sequence
  synthetic sequence
actctgcagcgga

SEQ ID NO: 7697 - DNA, 13 bp, Artificial Sequence
  synthetic sequence
cgtgtagatcagg

SEQ ID NO: 7698 - DNA, 13 bp, Artificial Sequence
  synthetic sequence
atgggacgctcta

SEQ ID NO: 7699 - DNA, 13 bp, Artificial Sequence
  synthetic sequence
atggtgacaattg

SEQ ID NO: 7700 - DNA, 13 bp, Artificial Sequence
  synthetic sequence
tatcaatagactg

SEQ ID NO: 7701 - DNA, 13 bp, Artificial Sequence
  synthetic sequence
atgcagcgcttgt

SEQ ID NO: 7702 - DNA, 13 bp, Artificial Sequence
  synthetic sequence
cagctcaagtgtc

SEQ ID NO: 7703 - DNA, 13 bp, Artificial Sequence
  synthetic sequence
tgtggtttagagc

SEQ ID NO: 7704 - DNA, 13 bp, Artificial Sequence
  synthetic sequence
caattagatcagt

SEQ ID NO: 7705 - DNA, 13 bp, Artificial Sequence
  synthetic sequence
cagtacatgtatg

SEQ ID NO: 7706 - DNA, 13 bp, Artificial Sequence
  synthetic sequence
taaattacacaac

SEQ ID NO: 7707 - DNA, 13 bp, Artificial Sequence
  synthetic sequence
tagaagccctctt

SEQ ID NO: 7708 - DNA, 13 bp, Artificial Sequence
  synthetic sequence
tcttaaagagagg

SEQ ID NO: 7709 - DNA, 13 bp, Artificial Sequence
  synthetic sequence
gcggtaagcccac

SEQ ID NO: 7710 - DNA, 13 bp, Artificial Sequence
  synthetic sequence
gaacctggtgact

SEQ ID NO: 7711 - DNA, 13 bp, Artificial Sequence
  synthetic sequence
ctggaagagatgg

SEQ ID NO: 7712 - DNA, 13 bp, Artificial Sequence
  synthetic sequence
gacccgaagaaat

SEQ ID NO: 7713 - DNA, 13 bp, Artificial Sequence
  synthetic sequence
aaagtgagatata

SEQ ID NO: 7714 - DNA, 13 bp, Artificial Sequence
  synthetic sequence
atatggtatcaaa

SEQ ID NO: 7715 - DNA, 13 bp, Artificial Sequence
  synthetic sequence
tcaccaagcccag

SEQ ID NO: 7716 - DNA, 13 bp, Artificial Sequence
  synthetic sequence
actcactccctcc

SEQ ID NO: 7717 - DNA, 13 bp, Artificial Sequence
  synthetic sequence
tggtcaccctcac

SEQ ID NO: 7718 - DNA, 13 bp, Artificial Sequence
  synthetic sequence
atgcaacggcagt

SEQ ID NO: 7719 - DNA, 13 bp, Artificial Sequence
  synthetic sequence
ctgatgttttgac

SEQ ID NO: 7720 - DNA, 13 bp, Artificial Sequence
  synthetic sequence
tataccacccatg

SEQ ID NO: 7721 - DNA, 13 bp, Artificial Sequence
  synthetic sequence
cagtctgctgcct

SEQ ID NO: 7722 - DNA, 13 bp, Artificial Sequence
  synthetic sequence
ctgcagtagggtg

SEQ ID NO: 7723 - DNA, 13 bp, Artificial Sequence
  synthetic sequence
aaatcagcaagtt

SEQ ID NO: 7724 - DNA, 13 bp, Artificial Sequence
  synthetic sequence
acaccccacctgg

SEQ ID NO: 7725 - DNA, 13 bp, Artificial Sequence
  synthetic sequence
ctccaagcaaatg

SEQ ID NO: 7726 - DNA, 13 bp, Artificial Sequence
  synthetic sequence
ttctttagccgtg

SEQ ID NO: 7727 - DNA, 13 bp, Artificial Sequence
  synthetic sequence
ctccactatgcaa

SEQ ID NO: 7728 - DNA, 13 bp, Artificial Sequence
  synthetic sequence
atcaccggggcaa

SEQ ID NO: 7729 - DNA, 13 bp, Artificial Sequence
  synthetic sequence
atgggatatgctc

SEQ ID NO: 7730 - DNA, 13 bp, Artificial Sequence
  synthetic sequence
tgcacaccagtgc

SEQ ID NO: 7731 - DNA, 13 bp, Artificial Sequence
  synthetic sequence
caggttggtgcag

SEQ ID NO: 7732 - DNA, 13 bp, Artificial Sequence
  synthetic sequence
aagaaagggaaat

SEQ ID NO: 7733 - DNA, 13 bp, Artificial Sequence
  synthetic sequence
gtggctgtgctgc

SEQ ID NO: 7734 - DNA, 13 bp, Artificial Sequence
  synthetic sequence
aacagagcgcttc

SEQ ID NO: 7735 - DNA, 13 bp, Artificial Sequence
  synthetic sequence
tacaagacggacc

SEQ ID NO: 7736 - DNA, 13 bp, Artificial Sequence
  synthetic sequence
aaagaaccagcag

SEQ ID NO: 7737 - DNA, 13 bp, Artificial Sequence
  synthetic sequence
aggacattgagca

SEQ ID NO: 7738 - DNA, 13 bp, Artificial Sequence
  synthetic sequence
cccatcatgtgta

SEQ ID NO: 7739 - DNA, 13 bp, Artificial Sequence
  synthetic sequence
tcttctgtgacgt

SEQ ID NO: 7740 - DNA, 13 bp, Artificial Sequence
  synthetic sequence
acgacacaggaag

SEQ ID NO: 7741 - DNA, 13 bp, Artificial Sequence
  synthetic sequence
atcattagaggct

SEQ ID NO: 7742 - DNA, 13 bp, Artificial Sequence
  synthetic sequence
aatactgcaggga

SEQ ID NO: 7743 - DNA, 13 bp, Artificial Sequence
  synthetic sequence
aattgtgcaacca

SEQ ID NO: 7744 - DNA, 13 bp, Artificial Sequence
  synthetic sequence
gtgatgcagtcca

SEQ ID NO: 7745 - DNA, 13 bp, Artificial Sequence
  synthetic sequence
tttgcgggtctgc

SEQ ID NO: 7746 - DNA, 13 bp, Artificial Sequence
  synthetic sequence
gatcacgtgcgct

SEQ ID NO: 7747 - DNA, 13 bp, Artificial Sequence
  synthetic sequence
ctaagcaagctct

SEQ ID NO: 7748 - DNA, 13 bp, Artificial Sequence
  synthetic sequence
tacatggataaat

SEQ ID NO: 7749 - DNA, 13 bp, Artificial Sequence
  synthetic sequence
aaactcttgatta

SEQ ID NO: 7750 - DNA, 13 bp, Artificial Sequence
  synthetic sequence
tatatgtgggcaa

SEQ ID NO: 7751 - DNA, 13 bp, Artificial Sequence
  synthetic sequence
caattctgccagg

SEQ ID NO: 7752 - DNA, 13 bp, Artificial Sequence
  synthetic sequence
ttggtggatgagc

SEQ ID NO: 7753 - DNA, 13 bp, Artificial Sequence
  synthetic sequence
acagtttcagatt

SEQ ID NO: 7754 - DNA, 13 bp, Artificial Sequence
  synthetic sequence
cattgaagaacca

SEQ ID NO: 7755 - DNA, 13 bp, Artificial Sequence
  synthetic sequence
tgcaagtactacc

SEQ ID NO: 7756 - DNA, 13 bp, Artificial Sequence
  synthetic sequence
agggcatggatcc

SEQ ID NO: 7757 - DNA, 13 bp, Artificial Sequence
  synthetic sequence
aaagaaactggga

SEQ ID NO: 7758 - DNA, 13 bp, Artificial Sequence
  synthetic sequence
aagaagcaatgga

SEQ ID NO: 7759 - DNA, 13 bp, Artificial Sequence
  synthetic sequence
aggtgcaaactga

SEQ ID NO: 7760 - DNA, 13 bp, Artificial Sequence
  synthetic sequence
gaagccaaaagag

SEQ ID NO: 7761 - DNA, 13 bp, Artificial Sequence
  synthetic sequence
ttgactgctcgga

SEQ ID NO: 7762 - DNA, 13 bp, Artificial Sequence
  synthetic sequence
aacttagaagctt

SEQ ID NO: 7763 - DNA, 13 bp, Artificial Sequence
  synthetic sequence
tcacctcagtcgg

SEQ ID NO: 7764 - DNA, 13 bp, Artificial Sequence
  synthetic sequence
tttggtctactgg

SEQ ID NO: 7765 - DNA, 13 bp, Artificial Sequence
  synthetic sequence
tacacataccagg

SEQ ID NO: 7766 - DNA, 13 bp, Artificial Sequence
  synthetic sequence
gggagactgaaca

SEQ ID NO: 7767 - DNA, 13 bp, Artificial Sequence
  synthetic sequence
caaaaacagagtg

SEQ ID NO: 7768 - DNA, 13 bp, Artificial Sequence
  synthetic sequence
aaaccgatcaagg

SEQ ID NO: 7769 - DNA, 13 bp, Artificial Sequence
  synthetic sequence
gaccacgtgcgct

SEQ ID NO: 7770 - DNA, 13 bp, Artificial Sequence
  synthetic sequence
tcggtgggaatgg

SEQ ID NO: 7771 - DNA, 13 bp, Artificial Sequence
  synthetic sequence
aatcctgatgtgt

SEQ ID NO: 7772 - DNA, 13 bp, Artificial Sequence
  synthetic sequence
tggctggatgagg

SEQ ID NO: 7773 - DNA, 13 bp, Artificial Sequence
  synthetic sequence
gacttgttagtct

SEQ ID NO: 7774 - DNA, 13 bp, Artificial Sequence
  synthetic sequence
tcagactcagatg

SEQ ID NO: 7775 - DNA, 13 bp, Artificial Sequence
  synthetic sequence
ctacatggacaaa

SEQ ID NO: 7776 - DNA, 13 bp, Artificial Sequence
  synthetic sequence
ctcttgattaaaa

SEQ ID NO: 7777 - DNA, 13 bp, Artificial Sequence
  synthetic sequence
cattggacttcaa

SEQ ID NO: 7778 - DNA, 13 bp, Artificial Sequence
  synthetic sequence
ttaattggctcag

SEQ ID NO: 7779 - DNA, 13 bp, Artificial Sequence
  synthetic sequence
ttgactgctcaga

SEQ ID NO: 7780 - DNA, 13 bp, Artificial Sequence
  synthetic sequence
cacactagtgctg

SEQ ID NO: 7781 - DNA, 13 bp, Artificial Sequence
  synthetic sequence
tatagggtagtga

SEQ ID NO: 7782 - DNA, 13 bp, Artificial Sequence
  synthetic sequence
ggcaagatgctca

SEQ ID NO: 7783 - DNA, 13 bp, Artificial Sequence
  synthetic sequence
gagccagcagtct

SEQ ID NO: 7784 - DNA, 13 bp, Artificial Sequence
  synthetic sequence
tgcgagttgttca

SEQ ID NO: 7785 - DNA, 13 bp, Artificial Sequence
  synthetic sequence
ccactacacagcc

SEQ ID NO: 7786 - DNA, 13 bp, Artificial Sequence
  synthetic sequence
agcaacttagaag

SEQ ID NO: 7787 - DNA, 13 bp, Artificial Sequence
  synthetic sequence
tgattgaagccag

SEQ ID NO: 7788 - DNA, 13 bp, Artificial Sequence
  synthetic sequence
ctctttaactgca

SEQ ID NO: 7789 - DNA, 13 bp, Artificial Sequence
  synthetic sequence
tgaacctgtatgc

SEQ ID NO: 7790 - DNA, 13 bp, Artificial Sequence
  synthetic sequence
gactatgacatgg

SEQ ID NO: 7791 - DNA, 13 bp, Artificial Sequence
  synthetic sequence
ggatcaaccacac

SEQ ID NO: 7792 - DNA, 13 bp, Artificial Sequence
  synthetic sequence
atatgaggatcaa

SEQ ID NO: 7793 - DNA, 13 bp, Artificial Sequence
  synthetic sequence
atgaaattatgca

SEQ ID NO: 7794 - DNA, 13 bp, Artificial Sequence
  synthetic sequence
gtaacttagaagt

SEQ ID NO: 7795 - DNA, 13 bp, Artificial Sequence
  synthetic sequence
gtgatgcaatcca

SEQ ID NO: 7796 - DNA, 13 bp, Artificial Sequence
  synthetic sequence
ttcttcagccgtg

SEQ ID NO: 7797 - DNA, 13 bp, Artificial Sequence
  synthetic sequence
gccactctatgcg

SEQ ID NO: 7798 - DNA, 13 bp, Artificial Sequence
  synthetic sequence
atggatgttatac

SEQ ID NO: 7799 - DNA, 13 bp, Artificial Sequence
  synthetic sequence
ctagtgtggatag

SEQ ID NO: 7800 - DNA, 13 bp, Artificial Sequence
  synthetic sequence
aggcagtgaaaca

SEQ ID NO: 7801 - DNA, 13 bp, Artificial Sequence
  synthetic sequence
tggacaagtatgg

SEQ ID NO: 7802 - DNA, 13 bp, Artificial Sequence
  synthetic sequence
ctccaagcaaacg

SEQ ID NO: 7803 - DNA, 13 bp, Artificial Sequence
  synthetic sequence
tacaagacagacc

SEQ ID NO: 7804 - DNA, 13 bp, Artificial Sequence
  synthetic sequence
gaaccaataattg

SEQ ID NO: 7805 - DNA, 13 bp, Artificial Sequence
  synthetic sequence
tgaggattaaaca

SEQ ID NO: 7806 - DNA, 13 bp, Artificial Sequence
  synthetic sequence
cattggatttcaa

SEQ ID NO: 7807 - DNA, 13 bp, Artificial Sequence
  synthetic sequence
atattgctcctta

SEQ ID NO: 7808 - DNA, 13 bp, Artificial Sequence
  synthetic sequence
tgcacgagcctga

SEQ ID NO: 7809 - DNA, 13 bp, Artificial Sequence
  synthetic sequence
aaggaaaatcccg

SEQ ID NO: 7810 - DNA, 13 bp, Artificial Sequence
  synthetic sequence
tttgggattttgg

SEQ ID NO: 7811 - DNA, 13 bp, Artificial Sequence
  synthetic sequence
tcaccaagcctag

SEQ ID NO: 7812 - DNA, 13 bp, Artificial Sequence
  synthetic sequence
ccatcacgacgca

SEQ ID NO: 7813 - DNA, 13 bp, Artificial Sequence
  synthetic sequence
gctagtgtggaca

SEQ ID NO: 7814 - DNA, 13 bp, Artificial Sequence
  synthetic sequence
tggctataccaaa

SEQ ID NO: 7815 - DNA, 13 bp, Artificial Sequence
  synthetic sequence
ctccctaactgca

SEQ ID NO: 7816 - DNA, 13 bp, Artificial Sequence
  synthetic sequence
tcggagggaacgg

SEQ ID NO: 7817 - DNA, 13 bp, Artificial Sequence
  synthetic sequence
aagaccctagact

SEQ ID NO: 7818 - DNA, 13 bp, Artificial Sequence
  synthetic sequence
tcatcagaggctc

SEQ ID NO: 7819 - DNA, 13 bp, Artificial Sequence
  synthetic sequence
ataactatatggt

SEQ ID NO: 7820 - DNA, 13 bp, Artificial Sequence
  synthetic sequence
gtgtttttggtca

SEQ ID NO: 7821 - DNA, 13 bp, Artificial Sequence
  synthetic sequence
ccttttcctattg

SEQ ID NO: 7822 - DNA, 13 bp, Artificial Sequence
  synthetic sequence
tggatgaagccca

SEQ ID NO: 7823 - DNA, 13 bp, Artificial Sequence
  synthetic sequence
gggctttctacca

SEQ ID NO: 7824 - DNA, 13 bp, Artificial Sequence
  synthetic sequence
gggtacaaacaac

SEQ ID NO: 7825 - DNA, 13 bp, Artificial Sequence
  synthetic sequence
tacatgtacgtcc

SEQ ID NO: 7826 - DNA, 13 bp, Artificial Sequence
  synthetic sequence
tagagcagtctgc

SEQ ID NO: 7827 - DNA, 13 bp, Artificial Sequence
  synthetic sequence
ttagtagatgagc

SEQ ID NO: 7828 - DNA, 13 bp, Artificial Sequence
  synthetic sequence
ttcattgattggc

SEQ ID NO: 7829 - DNA, 13 bp, Artificial Sequence
  synthetic sequence
ctgcatcagaggg

SEQ ID NO: 7830 - DNA, 13 bp, Artificial Sequence
  synthetic sequence
gtaactacagagt

SEQ ID NO: 7831 - DNA, 13 bp, Artificial Sequence
  synthetic sequence
aatgctagtgaca

SEQ ID NO: 7832 - DNA, 13 bp, Artificial Sequence
  synthetic sequence
tggacgctgtcga

SEQ ID NO: 7833 - DNA, 13 bp, Artificial Sequence
  synthetic sequence
agagacaggaagt

SEQ ID NO: 7834 - DNA, 13 bp, Artificial Sequence
  synthetic sequence
acagccacagtcc

SEQ ID NO: 7835 - DNA, 13 bp, Artificial Sequence
  synthetic sequence
tcctctggttgga

SEQ ID NO: 7836 - DNA, 13 bp, Artificial Sequence
  synthetic sequence
cgccaggcagtaa

SEQ ID NO: 7837 - DNA, 13 bp, Artificial Sequence
  synthetic sequence
cgcaagtttcaac

SEQ ID NO: 7838 - DNA, 13 bp, Artificial Sequence
  synthetic sequence
cattgaggcactc

SEQ ID NO: 7839 - DNA, 13 bp, Artificial Sequence
  synthetic sequence
gctttactggtgg

SEQ ID NO: 7840 - DNA, 13 bp, Artificial Sequence
  synthetic sequence
ttgagaacagcta

SEQ ID NO: 7841 - DNA, 13 bp, Artificial Sequence
  synthetic sequence
agtggcaagccca

SEQ ID NO: 7842 - DNA, 13 bp, Artificial Sequence
  synthetic sequence
tattctgtcagat

SEQ ID NO: 7843 - DNA, 13 bp, Artificial Sequence
  synthetic sequence
aatccatagcgac

SEQ ID NO: 7844 - DNA, 13 bp, Artificial Sequence
  synthetic sequence
agcaacatcattg

SEQ ID NO: 7845 - DNA, 13 bp, Artificial Sequence
  synthetic sequence
cagtatctagaga

SEQ ID NO: 7846 - DNA, 13 bp, Artificial Sequence
  synthetic sequence
agtggtgctagcg

SEQ ID NO: 7847 - DNA, 13 bp, Artificial Sequence
  synthetic sequence
ccgtggcagtcca

SEQ ID NO: 7848 - DNA, 13 bp, Artificial Sequence
  synthetic sequence
aagggatcaatca

SEQ ID NO: 7849 - DNA, 13 bp, Artificial Sequence
  synthetic sequence
gttcgttacccgg

SEQ ID NO: 7850 - DNA, 13 bp, Artificial Sequence
  synthetic sequence
ccattggaaactc

SEQ ID NO: 7851 - DNA, 13 bp, Artificial Sequence
  synthetic sequence
cagccactctacg

SEQ ID NO: 7852 - DNA, 13 bp, Artificial Sequence
  synthetic sequence
agtctcagcccag

SEQ ID NO: 7853 - DNA, 13 bp, Artificial Sequence
  synthetic sequence
accaatgagacca

SEQ ID NO: 7854 - DNA, 13 bp, Artificial Sequence
  synthetic sequence
cgcaacactcagg

SEQ ID NO: 7855 - DNA, 13 bp, Artificial Sequence
  synthetic sequence
tcagggccatttc

SEQ ID NO: 7856 - DNA, 13 bp, Artificial Sequence
  synthetic sequence
gtaccttaatcaa

SEQ ID NO: 7857 - DNA, 13 bp, Artificial Sequence
  synthetic sequence
tgctaagaacagc

SEQ ID NO: 7858 - DNA, 13 bp, Artificial Sequence
  synthetic sequence
ttggagaaccaaa

SEQ ID NO: 7859 - DNA, 13 bp, Artificial Sequence
  synthetic sequence
atacatataccag

SEQ ID NO: 7860 - DNA, 13 bp, Artificial Sequence
  synthetic sequence
tcaccaagtttat

SEQ ID NO: 7861 - DNA, 13 bp, Artificial Sequence
  synthetic sequence
tggattaacttaa

SEQ ID NO: 7862 - DNA, 13 bp, Artificial Sequence
  synthetic sequence
ctcaaagagaaga

SEQ ID NO: 7863 - DNA, 13 bp, Artificial Sequence
  synthetic sequence
gaccattttgatg

SEQ ID NO: 7864 - DNA, 13 bp, Artificial Sequence
  synthetic sequence
ctgacgtgtcagt

SEQ ID NO: 7865 - DNA, 13 bp, Artificial Sequence
  synthetic sequence
agtcttctgtaac

SEQ ID NO: 7866 - DNA, 13 bp, Artificial Sequence
  synthetic sequence
ccagcccaagtgt

SEQ ID NO: 7867 - DNA, 13 bp, Artificial Sequence
  synthetic sequence
tcaggtgccaaca

SEQ ID NO: 7868 - DNA, 13 bp, Artificial Sequence
  synthetic sequence
tggtttctacagt

SEQ ID NO: 7869 - DNA, 13 bp, Artificial Sequence
  synthetic sequence
taatcagaactct

SEQ ID NO: 7870 - DNA, 13 bp, Artificial Sequence
  synthetic sequence
gcagtgtctaggg

SEQ ID NO: 7871 - DNA, 13 bp, Artificial Sequence
  synthetic sequence
agtaaatttcacc

SEQ ID NO: 7872 - DNA, 13 bp, Artificial Sequence
  synthetic sequence
tggccaatgcccg

SEQ ID NO: 7873 - DNA, 13 bp, Artificial Sequence
  synthetic sequence
gacgtatcagtga

SEQ ID NO: 7874 - DNA, 13 bp, Artificial Sequence
  synthetic sequence
aggatacagaaga

SEQ ID NO: 7875 - DNA, 13 bp, Artificial Sequence
  synthetic sequence
gggaatttcttta

SEQ ID NO: 7876 - DNA, 13 bp, Artificial Sequence
  synthetic sequence
atggggtatgctc

SEQ ID NO: 7877 - DNA, 13 bp, Artificial Sequence
  synthetic sequence
tatagggtggtga

SEQ ID NO: 7878 - DNA, 13 bp, Artificial Sequence
  synthetic sequence
gccgcaagttcca

SEQ ID NO: 7879 - DNA, 13 bp, Artificial Sequence
  synthetic sequence
atgctgttgaatt

SEQ ID NO: 7880 - DNA, 13 bp, Artificial Sequence
  synthetic sequence
agcctctattctt

SEQ ID NO: 7881 - DNA, 13 bp, Artificial Sequence
  synthetic sequence
accacacagcctg

SEQ ID NO: 7882 - DNA, 13 bp, Artificial Sequence
  synthetic sequence
ctgatgagtatgt

SEQ ID NO: 7883 - DNA, 13 bp, Artificial Sequence
  synthetic sequence
gaacctgtatgtc

SEQ ID NO: 7884 - DNA, 13 bp, Artificial Sequence
  synthetic sequence
ccacatcagtgga

SEQ ID NO: 7885 - DNA, 13 bp, Artificial Sequence
  synthetic sequence
aagatcattggaa

SEQ ID NO: 7886 - DNA, 13 bp, Artificial Sequence
  synthetic sequence
acctggcgactgt

SEQ ID NO: 7887 - DNA, 13 bp, Artificial Sequence
  synthetic sequence
agggtatacatga

SEQ ID NO: 7888 - DNA, 13 bp, Artificial Sequence
  synthetic sequence
tttaccatgaaac

SEQ ID NO: 7889 - DNA, 13 bp, Artificial Sequence
  synthetic sequence
atccattccctat

SEQ ID NO: 7890 - DNA, 13 bp, Artificial Sequence
  synthetic sequence
aacaccatagaag

SEQ ID NO: 7891 - DNA, 13 bp, Artificial Sequence
  synthetic sequence
ctattgagctagt

SEQ ID NO: 7892 - DNA, 13 bp, Artificial Sequence
  synthetic sequence
tggtgccattaga

SEQ ID NO: 7893 - DNA, 13 bp, Artificial Sequence
  synthetic sequence
agtctacaatact

SEQ ID NO: 7894 - DNA, 13 bp, Artificial Sequence
  synthetic sequence
gttaccatatagc

SEQ ID NO: 7895 - DNA, 13 bp, Artificial Sequence
  synthetic sequence
aatgctcatcgcc

SEQ ID NO: 7896 - DNA, 13 bp, Artificial Sequence
  synthetic sequence
cgccaggcggtaa

SEQ ID NO: 7897 - DNA, 13 bp, Artificial Sequence
  synthetic sequence
ccattcaaactct

SEQ ID NO: 7898 - DNA, 13 bp, Artificial Sequence
  synthetic sequence
ggcattataacca

SEQ ID NO: 7899 - DNA, 13 bp, Artificial Sequence
  synthetic sequence
aaggacattttac

SEQ ID NO: 7900 - DNA, 13 bp, Artificial Sequence
  synthetic sequence
cacaggctgctct

SEQ ID NO: 7901 - DNA, 13 bp, Artificial Sequence
  synthetic sequence
tgggacttcggat

SEQ ID NO: 7902 - DNA, 13 bp, Artificial Sequence
  synthetic sequence
tatggcactgaat

SEQ ID NO: 7903 - DNA, 13 bp, Artificial Sequence
  synthetic sequence
gtaaattccacca

SEQ ID NO: 7904 - DNA, 13 bp, Artificial Sequence
  synthetic sequence
cacactatcacga

SEQ ID NO: 7905 - DNA, 13 bp, Artificial Sequence
  synthetic sequence
agtttcaccaaac

SEQ ID NO: 7906 - DNA, 13 bp, Artificial Sequence
  synthetic sequence
gatgtgtcagtga

SEQ ID NO: 7907 - DNA, 13 bp, Artificial Sequence
  synthetic sequence
aagactggcaaag

SEQ ID NO: 7908 - DNA, 13 bp, Artificial Sequence
  synthetic sequence
ccaccgtggttgc

SEQ ID NO: 7909 - DNA, 13 bp, Artificial Sequence
  synthetic sequence
accgctccttaac

SEQ ID NO: 7910 - DNA, 13 bp, Artificial Sequence
  synthetic sequence
accaaaatgaaat

SEQ ID NO: 7911 - DNA, 13 bp, Artificial Sequence
  synthetic sequence
ttcaattaagaga

SEQ ID NO: 7912 - DNA, 13 bp, Artificial Sequence
  synthetic sequence
agtgaaacttaga

SEQ ID NO: 7913 - DNA, 13 bp, Artificial Sequence
  synthetic sequence
ggtttctaaatct

SEQ ID NO: 7914 - DNA, 13 bp, Artificial Sequence
  synthetic sequence
gttaccctcacag

SEQ ID NO: 7915 - DNA, 13 bp, Artificial Sequence
  synthetic sequence
taactgtgcaacc

SEQ ID NO: 7916 - DNA, 13 bp, Artificial Sequence
  synthetic sequence
gatgtcttaacag

SEQ ID NO: 7917 - DNA, 13 bp, Artificial Sequence
  synthetic sequence
cacattggtggga

SEQ ID NO: 7918 - DNA, 13 bp, Artificial Sequence
  synthetic sequence
gggttacagtctt

SEQ ID NO: 7919 - DNA, 13 bp, Artificial Sequence
  synthetic sequence
aaactggaagact

SEQ ID NO: 7920 - DNA, 13 bp, Artificial Sequence
  synthetic sequence
tcaaccaatgcta

SEQ ID NO: 7921 - DNA, 13 bp, Artificial Sequence
  synthetic sequence
tggtcactctcac

SEQ ID NO: 7922 - DNA, 13 bp, Artificial Sequence
  synthetic sequence
atgtcagggatct

SEQ ID NO: 7923 - DNA, 13 bp, Artificial Sequence
  synthetic sequence
ccattgggaactc

SEQ ID NO: 7924 - DNA, 13 bp, Artificial Sequence
  synthetic sequence
gaggttcgacaat

SEQ ID NO: 7925 - DNA, 13 bp, Artificial Sequence
  synthetic sequence
attaaccacactc

SEQ ID NO: 7926 - DNA, 13 bp, Artificial Sequence
  synthetic sequence
ttctcaggtgtca

SEQ ID NO: 7927 - DNA, 13 bp, Artificial Sequence
  synthetic sequence
aagttcattgact

SEQ ID NO: 7928 - DNA, 13 bp, Artificial Sequence
  synthetic sequence
ctttgctggtggc

SEQ ID NO: 7929 - DNA, 13 bp, Artificial Sequence
  synthetic sequence
tttgtcaaatggt

SEQ ID NO: 7930 - DNA, 13 bp, Artificial Sequence
  synthetic sequence
caagggtgcgaca

SEQ ID NO: 7931 - DNA, 13 bp, Artificial Sequence
  synthetic sequence
gcaaggatcccag

SEQ ID NO: 7932 - DNA, 13 bp, Artificial Sequence
  synthetic sequence
ggctggatgaaga

SEQ ID NO: 7933 - DNA, 13 bp, Artificial Sequence
  synthetic sequence
tttggtcaaaatg

SEQ ID NO: 7934 - DNA, 13 bp, Artificial Sequence
  synthetic sequence
caagtgaatcgct

SEQ ID NO: 7935 - DNA, 13 bp, Artificial Sequence
  synthetic sequence
gatgctgttgagt

SEQ ID NO: 7936 - DNA, 13 bp, Artificial Sequence
  synthetic sequence
aaggacacttcac

SEQ ID NO: 7937 - DNA, 13 bp, Artificial Sequence
  synthetic sequence
gaagctattgacc

SEQ ID NO: 7938 - DNA, 13 bp, Artificial Sequence
  synthetic sequence
gattggctcaagg

SEQ ID NO: 7939 - DNA, 13 bp, Artificial Sequence
  synthetic sequence
ttatggttagatg

SEQ ID NO: 7940 - DNA, 13 bp, Artificial Sequence
  synthetic sequence
ttacctgggaaaa

SEQ ID NO: 7941 - DNA, 13 bp, Artificial Sequence
  synthetic sequence
caacttagaagca

SEQ ID NO: 7942 - DNA, 13 bp, Artificial Sequence
  synthetic sequence
atcaggtcgatga

SEQ ID NO: 7943 - DNA, 13 bp, Artificial Sequence
  synthetic sequence
aattggtcaatgt

SEQ ID NO: 7944 - DNA, 13 bp, Artificial Sequence
  synthetic sequence
ccatacacaccat

SEQ ID NO: 7945 - DNA, 13 bp, Artificial Sequence
  synthetic sequence
accaacgccagca

SEQ ID NO: 7946 - DNA, 13 bp, Artificial Sequence
  synthetic sequence
gatggaccaagga

SEQ ID NO: 7947 - DNA, 13 bp, Artificial Sequence
  synthetic sequence
aatgaagttctac

SEQ ID NO: 7948 - DNA, 13 bp, Artificial Sequence
  synthetic sequence
ccgttggacttca

SEQ ID NO: 7949 - DNA, 13 bp, Artificial Sequence
  synthetic sequence
cctgatgaatatg

SEQ ID NO: 7950 - DNA, 13 bp, Artificial Sequence
  synthetic sequence
cttcagactctta

SEQ ID NO: 7951 - DNA, 13 bp, Artificial Sequence
  synthetic sequence
gtagggccgctaa

SEQ ID NO: 7952 - DNA, 13 bp, Artificial Sequence
  synthetic sequence
taggtatagtgtt

SEQ ID NO: 7953 - DNA, 13 bp, Artificial Sequence
  synthetic sequence
gtcagcagttggg

SEQ ID NO: 7954 - DNA, 13 bp, Artificial Sequence
  synthetic sequence
tgttgatcatgca

SEQ ID NO: 7955 - DNA, 13 bp, Artificial Sequence
  synthetic sequence
gtctggttcaggg

SEQ ID NO: 7956 - DNA, 13 bp, Artificial Sequence
  synthetic sequence
ctaagactggcaa

SEQ ID NO: 7957 - DNA, 13 bp, Artificial Sequence
  synthetic sequence
tggctgtgttgcc

SEQ ID NO: 7958 - DNA, 13 bp, Artificial Sequence
  synthetic sequence
atcagaggctcac

SEQ ID NO: 7959 - DNA, 13 bp, Artificial Sequence
  synthetic sequence
gcattattacaat

SEQ ID NO: 7960 - DNA, 13 bp, Artificial Sequence
  synthetic sequence
cccaccatgtgta

SEQ ID NO: 7961 - DNA, 13 bp, Artificial Sequence
  synthetic sequence
tccacaccagcgc

SEQ ID NO: 7962 - DNA, 13 bp, Artificial Sequence
  synthetic sequence
caactttggcctg

SEQ ID NO: 7963 - DNA, 13 bp, Artificial Sequence
  synthetic sequence
cagcctaaatgac

SEQ ID NO: 7964 - DNA, 13 bp, Artificial Sequence
  synthetic sequence
agagacgatcacc

SEQ ID NO: 7965 - DNA, 13 bp, Artificial Sequence
  synthetic sequence
actggcatcataa

SEQ ID NO: 7966 - DNA, 13 bp, Artificial Sequence
  synthetic sequence
tatcctttcccaa

SEQ ID NO: 7967 - DNA, 13 bp, Artificial Sequence
  synthetic sequence
accaccgctcagg

SEQ ID NO: 7968 - DNA, 13 bp, Artificial Sequence
  synthetic sequence
gatcaacaacatc

SEQ ID NO: 7969 - DNA, 13 bp, Artificial Sequence
  synthetic sequence
gacatcactaagt

SEQ ID NO: 7970 - DNA, 13 bp, Artificial Sequence
  synthetic sequence
aagaggcttcttg

SEQ ID NO: 7971 - DNA, 13 bp, Artificial Sequence
  synthetic sequence
aaggagactggca

SEQ ID NO: 7972 - DNA, 13 bp, Artificial Sequence
  synthetic sequence
ctgggcgtaatgg

SEQ ID NO: 7973 - DNA, 13 bp, Artificial Sequence
  synthetic sequence
gttgacagtgaag

SEQ ID NO: 7974 - DNA, 13 bp, Artificial Sequence
  synthetic sequence
accctgtcatgga

SEQ ID NO: 7975 - DNA, 13 bp, Artificial Sequence
  synthetic sequence
agatgccaacacg

SEQ ID NO: 7976 - DNA, 13 bp, Artificial Sequence
  synthetic sequence
tacatgtacgtgc

SEQ ID NO: 7977 - DNA, 13 bp, Artificial Sequence
  synthetic sequence
gccatctatgtgg

SEQ ID NO: 7978 - DNA, 13 bp, Artificial Sequence
  synthetic sequence
cctaacaacatga

SEQ ID NO: 7979 - DNA, 13 bp, Artificial Sequence
  synthetic sequence
ggaaattcccgga

SEQ ID NO: 7980 - DNA, 13 bp, Artificial Sequence
  synthetic sequence
gttgtacagtatg

SEQ ID NO: 7981 - DNA, 13 bp, Artificial Sequence
  synthetic sequence
gggaaaatgttaa

SEQ ID NO: 7982 - DNA, 13 bp, Artificial Sequence
  synthetic sequence
atatgagaatcaa

SEQ ID NO: 7983 - DNA, 13 bp, Artificial Sequence
  synthetic sequence
gtgacatctgttg

SEQ ID NO: 7984 - DNA, 13 bp, Artificial Sequence
  synthetic sequence
tggtatcagacaa

SEQ ID NO: 7985 - DNA, 13 bp, Artificial Sequence
  synthetic sequence
tatgggattttgg

SEQ ID NO: 7986 - DNA, 13 bp, Artificial Sequence
  synthetic sequence
caatctgctgctt

SEQ ID NO: 7987 - DNA, 13 bp, Artificial Sequence
  synthetic sequence
aaagccattcaac

SEQ ID NO: 7988 - DNA, 13 bp, Artificial Sequence
  synthetic sequence
cacaagaagctgc

SEQ ID NO: 7989 - DNA, 13 bp, Artificial Sequence
  synthetic sequence
ggcgcttggatgc

SEQ ID NO: 7990 - DNA, 13 bp, Artificial Sequence
  synthetic sequence
caccagctcaagt

SEQ ID NO: 7991 - DNA, 13 bp, Artificial Sequence
  synthetic sequence
taataccatggat

SEQ ID NO: 7992 - DNA, 13 bp, Artificial Sequence
  synthetic sequence
catcatagtgcca

SEQ ID NO: 7993 - DNA, 13 bp, Artificial Sequence
  synthetic sequence
gtgatgcagtcta

SEQ ID NO: 7994 - DNA, 13 bp, Artificial Sequence
  synthetic sequence
ttgattcacatcc

SEQ ID NO: 7995 - DNA, 13 bp, Artificial Sequence
  synthetic sequence
gcacaaaagcaga

SEQ ID NO: 7996 - DNA, 13 bp, Artificial Sequence
  synthetic sequence
tatgatgcaagcc

SEQ ID NO: 7997 - DNA, 13 bp, Artificial Sequence
  synthetic sequence
tgaagagagggtt

SEQ ID NO: 7998 - DNA, 13 bp, Artificial Sequence
  synthetic sequence
acatacctggtga

SEQ ID NO: 7999 - DNA, 13 bp, Artificial Sequence
  synthetic sequence
accacccagccag

SEQ ID NO: 8000 - DNA, 13 bp, Artificial Sequence
  synthetic sequence
agggatgtgacac

SEQ ID NO: 8001 - DNA, 13 bp, Artificial Sequence
  synthetic sequence
aagcaaaccctca

SEQ ID NO: 8002 - DNA, 13 bp, Artificial Sequence
  synthetic sequence
caaagccatccaa

SEQ ID NO: 8003 - DNA, 13 bp, Artificial Sequence
  synthetic sequence
gtgttagatgccg

SEQ ID NO: 8004 - DNA, 13 bp, Artificial Sequence
  synthetic sequence
cagccactgtacg

SEQ ID NO: 8005 - DNA, 13 bp, Artificial Sequence
  synthetic sequence
caaatttaccccc

SEQ ID NO: 8006 - DNA, 13 bp, Artificial Sequence
  synthetic sequence
attagccgcattc

SEQ ID NO: 8007 - DNA, 13 bp, Artificial Sequence
  synthetic sequence
cacccaaagtagt

SEQ ID NO: 8008 - DNA, 13 bp, Artificial Sequence
  synthetic sequence
tgaactgcatgta

SEQ ID NO: 8009 - DNA, 13 bp, Artificial Sequence
  synthetic sequence
tgtacatcatggt

SEQ ID NO: 8010 - DNA, 13 bp, Artificial Sequence
  synthetic sequence
acagaagtgcttg

SEQ ID NO: 8011 - DNA, 13 bp, Artificial Sequence
  synthetic sequence
ggcattccaccaa

SEQ ID NO: 8012 - DNA, 13 bp, Artificial Sequence
  synthetic sequence
caaacatgaatgt

SEQ ID NO: 8013 - DNA, 13 bp, Artificial Sequence
  synthetic sequence
gacatatcctggc

SEQ ID NO: 8014 - DNA, 13 bp, Artificial Sequence
  synthetic sequence
gtttctcgaagta

SEQ ID NO: 8015 - DNA, 13 bp, Artificial Sequence
  synthetic sequence
acactcctttctc

SEQ ID NO: 8016 - DNA, 13 bp, Artificial Sequence
  synthetic sequence
tcaaagtacccag

SEQ ID NO: 8017 - DNA, 13 bp, Artificial Sequence
  synthetic sequence
tggcccaagattt

SEQ ID NO: 8018 - DNA, 13 bp, Artificial Sequence
  synthetic sequence
ccaatttcttctc

SEQ ID NO: 8019 - DNA, 13 bp, Artificial Sequence
  synthetic sequence
catcataaaacca

SEQ ID NO: 8020 - DNA, 13 bp, Artificial Sequence
  synthetic sequence
tatttgtcagcaa

SEQ ID NO: 8021 - DNA, 13 bp, Artificial Sequence
  synthetic sequence
gctccaatttggt

SEQ ID NO: 8022 - DNA, 13 bp, Artificial Sequence
  synthetic sequence
ctgcatatttcca

SEQ ID NO: 8023 - DNA, 13 bp, Artificial Sequence
  synthetic sequence
cctcccacacaag

SEQ ID NO: 8024 - DNA, 13 bp, Artificial Sequence
  synthetic sequence
tgtggtgacttct

SEQ ID NO: 8025 - DNA, 13 bp, Artificial Sequence
  synthetic sequence
cttgtgaccccat

SEQ ID NO: 8026 - DNA, 13 bp, Artificial Sequence
  synthetic sequence
caatagctctgtt

SEQ ID NO: 8027 - DNA, 13 bp, Artificial Sequence
  synthetic sequence
ctgatggcatctg

SEQ ID NO: 8028 - DNA, 13 bp, Artificial Sequence
  synthetic sequence
gatttctcagagg

SEQ ID NO: 8029 - DNA, 13 bp, Artificial Sequence
  synthetic sequence
ccagtggagacaa

SEQ ID NO: 8030 - DNA, 13 bp, Artificial Sequence
  synthetic sequence
catccataacagt

SEQ ID NO: 8031 - DNA, 13 bp, Artificial Sequence
  synthetic sequence
gtggaatagggca

SEQ ID NO: 8032 - DNA, 13 bp, Artificial Sequence
  synthetic sequence
tcctctgagtagc

SEQ ID NO: 8033 - DNA, 13 bp, Artificial Sequence
  synthetic sequence
tccccataggcta

SEQ ID NO: 8034 - DNA, 13 bp, Artificial Sequence
  synthetic sequence
aattcagcatcaa

SEQ ID NO: 8035 - DNA, 13 bp, Artificial Sequence
  synthetic sequence
tcattaaacttct

SEQ ID NO: 8036 - DNA, 13 bp, Artificial Sequence
  synthetic sequence
cacgtaagggtgc

SEQ ID NO: 8037 - DNA, 13 bp, Artificial Sequence
  synthetic sequence
tcatgggcatggt

SEQ ID NO: 8038 - DNA, 13 bp, Artificial Sequence
  synthetic sequence
gggctgcatctct

SEQ ID NO: 8039 - DNA, 13 bp, Artificial Sequence
  synthetic sequence
tctgtcacctcta

SEQ ID NO: 8040 - DNA, 13 bp, Artificial Sequence
  synthetic sequence
aacacatcatctc

SEQ ID NO: 8041 - DNA, 13 bp, Artificial Sequence
  synthetic sequence
tcaccaagttctt

SEQ ID NO: 8042 - DNA, 13 bp, Artificial Sequence
  synthetic sequence
catgacacccaat

SEQ ID NO: 8043 - DNA, 13 bp, Artificial Sequence
  synthetic sequence
cagatgggttggt

SEQ ID NO: 8044 - DNA, 13 bp, Artificial Sequence
  synthetic sequence
gtgggagcaccaa

SEQ ID NO: 8045 - DNA, 13 bp, Artificial Sequence
  synthetic sequence
cactataggggta

SEQ ID NO: 8046 - DNA, 13 bp, Artificial Sequence
  synthetic sequence
cactggcaaagta

SEQ ID NO: 8047 - DNA, 13 bp, Artificial Sequence
  synthetic sequence
cagcaagcatgag

SEQ ID NO: 8048 - DNA, 13 bp, Artificial Sequence
  synthetic sequence
ctggaattatcca

SEQ ID NO: 8049 - DNA, 13 bp, Artificial Sequence
  synthetic sequence
ttcccattatgcc

SEQ ID NO: 8050 - DNA, 13 bp, Artificial Sequence
  synthetic sequence
gtgtgagttccaa

SEQ ID NO: 8051 - DNA, 13 bp, Artificial Sequence
  synthetic sequence
gctgtgattctgt

SEQ ID NO: 8052 - DNA, 13 bp, Artificial Sequence
  synthetic sequence
tggtaccaggttt

SEQ ID NO: 8053 - DNA, 13 bp, Artificial Sequence
  synthetic sequence
tagtggaactgag

SEQ ID NO: 8054 - DNA, 13 bp, Artificial Sequence
  synthetic sequence
tcagtgttgatga

SEQ ID NO: 8055 - DNA, 13 bp, Artificial Sequence
  synthetic sequence
aaggcagcacata

SEQ ID NO: 8056 - DNA, 13 bp, Artificial Sequence
  synthetic sequence
aacaaagcttgct

SEQ ID NO: 8057 - DNA, 13 bp, Artificial Sequence
  synthetic sequence
ctaaggtagactg

SEQ ID NO: 8058 - DNA, 13 bp, Artificial Sequence
  synthetic sequence
tcaaatgcaaaga

SEQ ID NO: 8059 - DNA, 13 bp, Artificial Sequence
  synthetic sequence
gatcactgtaacc

SEQ ID NO: 8060 - DNA, 13 bp, Artificial Sequence
  synthetic sequence
caaacatagcttc

SEQ ID NO: 8061 - DNA, 13 bp, Artificial Sequence
  synthetic sequence
ttatcttgtctct

SEQ ID NO: 8062 - DNA, 13 bp, Artificial Sequence
  synthetic sequence
ctggtacaacacc

SEQ ID NO: 8063 - DNA, 13 bp, Artificial Sequence
  synthetic sequence
atggctgtctcct

SEQ ID NO: 8064 - DNA, 13 bp, Artificial Sequence
  synthetic sequence
gtttttcctggtt

SEQ ID NO: 8065 - DNA, 13 bp, Artificial Sequence
  synthetic sequence
ttcaggttgttta

SEQ ID NO: 8066 - DNA, 13 bp, Artificial Sequence
  synthetic sequence
cacatgggagcta

SEQ ID NO: 8067 - DNA, 13 bp, Artificial Sequence
  synthetic sequence
acatactcaggca

SEQ ID NO: 8068 - DNA, 13 bp, Artificial Sequence
  synthetic sequence
ggtgtcattgtca

SEQ ID NO: 8069 - DNA, 13 bp, Artificial Sequence
  synthetic sequence
gggataaggcaaa

SEQ ID NO: 8070 - DNA, 13 bp, Artificial Sequence
  synthetic sequence
tctaattgcttta

SEQ ID NO: 8071 - DNA, 13 bp, Artificial Sequence
  synthetic sequence
tgttcatatatgg

SEQ ID NO: 8072 - DNA, 13 bp, Artificial Sequence
  synthetic sequence
caattgcacctag

SEQ ID NO: 8073 - DNA, 13 bp, Artificial Sequence
  synthetic sequence
tccccttgtatat

SEQ ID NO: 8074 - DNA, 13 bp, Artificial Sequence
  synthetic sequence
tctgtgtacccgt

SEQ ID NO: 8075 - DNA, 13 bp, Artificial Sequence
  synthetic sequence
caccgaggccttt

SEQ ID NO: 8076 - DNA, 13 bp, Artificial Sequence
  synthetic sequence
gtttggtcaatca

SEQ ID NO: 8077 - DNA, 13 bp, Artificial Sequence
  synthetic sequence
ttttccctggttg

SEQ ID NO: 8078 - DNA, 13 bp, Artificial Sequence
  synthetic sequence
ggtgtcattgtta

SEQ ID NO: 8079 - DNA, 13 bp, Artificial Sequence
  synthetic sequence
aatctgtgactac

SEQ ID NO: 8080 - DNA, 13 bp, Artificial Sequence
  synthetic sequence
cctccatgctcat

SEQ ID NO: 8081 - DNA, 13 bp, Artificial Sequence
  synthetic sequence
ttaacataaccat

SEQ ID NO: 8082 - DNA, 13 bp, Artificial Sequence
  synthetic sequence
gcaagcataagat

SEQ ID NO: 8083 - DNA, 13 bp, Artificial Sequence
  synthetic sequence
ttagctctgacac

SEQ ID NO: 8084 - DNA, 13 bp, Artificial Sequence
  synthetic sequence
ttcccattgtgcc

SEQ ID NO: 8085 - DNA, 13 bp, Artificial Sequence
  synthetic sequence
tggttcaacacac

SEQ ID NO: 8086 - DNA, 13 bp, Artificial Sequence
  synthetic sequence
ggttgttcaagaa

SEQ ID NO: 8087 - DNA, 13 bp, Artificial Sequence
  synthetic sequence
agcattgctgtga

SEQ ID NO: 8088 - DNA, 13 bp, Artificial Sequence
  synthetic sequence
gctatagtgactg

SEQ ID NO: 8089 - DNA, 13 bp, Artificial Sequence
  synthetic sequence
aaataacatagac

SEQ ID NO: 8090 - DNA, 13 bp, Artificial Sequence
  synthetic sequence
ccgagtacgtact

SEQ ID NO: 8091 - DNA, 13 bp, Artificial Sequence
  synthetic sequence
catctttcacata

SEQ ID NO: 8092 - DNA, 13 bp, Artificial Sequence
  synthetic sequence
gaatcaaaaggga

SEQ ID NO: 8093 - DNA, 13 bp, Artificial Sequence
  synthetic sequence
cagtgaagcccat

SEQ ID NO: 8094 - DNA, 13 bp, Artificial Sequence
  synthetic sequence
tctgcaccgacac

SEQ ID NO: 8095 - DNA, 13 bp, Artificial Sequence
  synthetic sequence
tcaccaggttctt

SEQ ID NO: 8096 - DNA, 13 bp, Artificial Sequence
  synthetic sequence
ttaccaaacatgg

SEQ ID NO: 8097 - DNA, 13 bp, Artificial Sequence
  synthetic sequence
ccataggctataa

SEQ ID NO: 8098 - DNA, 13 bp, Artificial Sequence
  synthetic sequence
ccaattccttctc

SEQ ID NO: 8099 - DNA, 13 bp, Artificial Sequence
  synthetic sequence
acatcatctccat

SEQ ID NO: 8100 - DNA, 13 bp, Artificial Sequence
  synthetic sequence
tcttaacacccaa

SEQ ID NO: 8101 - DNA, 13 bp, Artificial Sequence
  synthetic sequence
ttcccgaagtagt

SEQ ID NO: 8102 - DNA, 13 bp, Artificial Sequence
  synthetic sequence
taatttgggttgg

SEQ ID NO: 8103 - DNA, 13 bp, Artificial Sequence
  synthetic sequence
ggttggtggctgt

SEQ ID NO: 8104 - DNA, 13 bp, Artificial Sequence
  synthetic sequence
tcaaagggatccc

SEQ ID NO: 8105 - DNA, 13 bp, Artificial Sequence
  synthetic sequence
ccggtttgacaat

SEQ ID NO: 8106 - DNA, 13 bp, Artificial Sequence
  synthetic sequence
tcaaatgcaaaaa

SEQ ID NO: 8107 - DNA, 13 bp, Artificial Sequence
  synthetic sequence
cagtgaaacccat

SEQ ID NO: 8108 - DNA, 13 bp, Artificial Sequence
  synthetic sequence
atcttgtccctac

SEQ ID NO: 8109 - DNA, 13 bp, Artificial Sequence
  synthetic sequence
gtagtgagaaact

SEQ ID NO: 8110 - DNA, 13 bp, Artificial Sequence
  synthetic sequence
aaggcaaaatcta

SEQ ID NO: 8111 - DNA, 13 bp, Artificial Sequence
  synthetic sequence
ctaaaagtgccca

SEQ ID NO: 8112 - DNA, 13 bp, Artificial Sequence
  synthetic sequence
ccatcgtaaaacc

SEQ ID NO: 8113 - DNA, 13 bp, Artificial Sequence
  synthetic sequence
attggtaacttgc

SEQ ID NO: 8114 - DNA, 13 bp, Artificial Sequence
  synthetic sequence
aacattgagggca

SEQ ID NO: 8115 - DNA, 13 bp, Artificial Sequence
  synthetic sequence
tgttgatcactag

SEQ ID NO: 8116 - DNA, 13 bp, Artificial Sequence
  synthetic sequence
aacacactgggtt

SEQ ID NO: 8117 - DNA, 13 bp, Artificial Sequence
  synthetic sequence
atgcccgtagcaa

SEQ ID NO: 8118 - DNA, 13 bp, Artificial Sequence
  synthetic sequence
gccacaatatatg

SEQ ID NO: 8119 - DNA, 13 bp, Artificial Sequence
  synthetic sequence
gatcgatacaagt

SEQ ID NO: 8120 - DNA, 13 bp, Artificial Sequence
  synthetic sequence
attgtggggtgga

SEQ ID NO: 8121 - DNA, 13 bp, Artificial Sequence
  synthetic sequence
cagggttctgaca

SEQ ID NO: 8122 - DNA, 13 bp, Artificial Sequence
  synthetic sequence
tagagtggtggtt

SEQ ID NO: 8123 - DNA, 13 bp, Artificial Sequence
  synthetic sequence
ttgaacttcttca

SEQ ID NO: 8124 - DNA, 13 bp, Artificial Sequence
  synthetic sequence
gagctaagtacga

SEQ ID NO: 8125 - DNA, 13 bp, Artificial Sequence
  synthetic sequence
aagattgcttaga

SEQ ID NO: 8126 - DNA, 13 bp, Artificial Sequence
  synthetic sequence
tggctacaacaaa

SEQ ID NO: 8127 - DNA, 13 bp, Artificial Sequence
  synthetic sequence
tgtcacagtccat

SEQ ID NO: 8128 - DNA, 13 bp, Artificial Sequence
  synthetic sequence
ttagaattacagt

SEQ ID NO: 8129 - DNA, 13 bp, Artificial Sequence
  synthetic sequence
tcaaaatcaacct

SEQ ID NO: 8130 - DNA, 13 bp, Artificial Sequence
  synthetic sequence
tgttctgtgtgcc

SEQ ID NO: 8131 - DNA, 13 bp, Artificial Sequence
  synthetic sequence
ttatagatgacat

SEQ ID NO: 8132 - DNA, 13 bp, Artificial Sequence
  synthetic sequence
cgaagtccaaact

SEQ ID NO: 8133 - DNA, 13 bp, Artificial Sequence
  synthetic sequence
gagaatagggcct

SEQ ID NO: 8134 - DNA, 13 bp, Artificial Sequence
  synthetic sequence
ttctcattggtgt

SEQ ID NO: 8135 - DNA, 13 bp, Artificial Sequence
  synthetic sequence
acttcatacaggt

SEQ ID NO: 8136 - DNA, 13 bp, Artificial Sequence
  synthetic sequence
tgctcactagcaa

SEQ ID NO: 8137 - DNA, 13 bp, Artificial Sequence
  synthetic sequence
gagggacgtatcc

SEQ ID NO: 8138 - DNA, 13 bp, Artificial Sequence
  synthetic sequence
cgtgcacgcaaaa

SEQ ID NO: 8139 - DNA, 13 bp, Artificial Sequence
  synthetic sequence
cgttccacattgg

SEQ ID NO: 8140 - DNA, 13 bp, Artificial Sequence
  synthetic sequence
cgtctgcgaatcg

SEQ ID NO: 8141 - DNA, 13 bp, Artificial Sequence
  synthetic sequence
ccagtggactaca

SEQ ID NO: 8142 - DNA, 13 bp, Artificial Sequence
  synthetic sequence
ctgagtcaaaagg

SEQ ID NO: 8143 - DNA, 13 bp, Artificial Sequence
  synthetic sequence
tcaggtactatcc

SEQ ID NO: 8144 - DNA, 13 bp, Artificial Sequence
  synthetic sequence
tctctactagtgc

SEQ ID NO: 8145 - DNA, 13 bp, Artificial Sequence
  synthetic sequence
aaacaccatcatc

SEQ ID NO: 8146 - DNA, 13 bp, Artificial Sequence
  synthetic sequence
ctatgagtgatat

SEQ ID NO: 8147 - DNA, 13 bp, Artificial Sequence
  synthetic sequence
cattatgcgtggc

SEQ ID NO: 8148 - DNA, 13 bp, Artificial Sequence
  synthetic sequence
cctttgaatcctt

SEQ ID NO: 8149 - DNA, 13 bp, Artificial Sequence
  synthetic sequence
taacttccaggat

SEQ ID NO: 8150 - DNA, 13 bp, Artificial Sequence
  synthetic sequence
tccatactcatct

SEQ ID NO: 8151 - DNA, 13 bp, Artificial Sequence
  synthetic sequence
ctctcttcagtcc

SEQ ID NO: 8152 - DNA, 13 bp, Artificial Sequence
  synthetic sequence
acttttcgttggt

SEQ ID NO: 8153 - DNA, 13 bp, Artificial Sequence
  synthetic sequence
gccacgatatatg

SEQ ID NO: 8154 - DNA, 13 bp, Artificial Sequence
  synthetic sequence
gctttgatccatg

SEQ ID NO: 8155 - DNA, 13 bp, Artificial Sequence
  synthetic sequence
ctggtacaacgcc

SEQ ID NO: 8156 - DNA, 13 bp, Artificial Sequence
  synthetic sequence
atgcatccttgta

SEQ ID NO: 8157 - DNA, 13 bp, Artificial Sequence
  synthetic sequence
ctcctgcgatagt

SEQ ID NO: 8158 - DNA, 13 bp, Artificial Sequence
  synthetic sequence
aaagtcattctaa

SEQ ID NO: 8159 - DNA, 13 bp, Artificial Sequence
  synthetic sequence
cacacactagtgg

SEQ ID NO: 8160 - DNA, 13 bp, Artificial Sequence
  synthetic sequence
atgggaatctcag

SEQ ID NO: 8161 - DNA, 13 bp, Artificial Sequence
  synthetic sequence
tgctctgtaccga

SEQ ID NO: 8162 - DNA, 13 bp, Artificial Sequence
  synthetic sequence
gaaacccagcaaa

SEQ ID NO: 8163 - DNA, 13 bp, Artificial Sequence
  synthetic sequence
caaaccccacaag

SEQ ID NO: 8164 - DNA, 13 bp, Artificial Sequence
  synthetic sequence
tagtgtgtgttgc

SEQ ID NO: 8165 - DNA, 13 bp, Artificial Sequence
  synthetic sequence
ttctcttccagtg

SEQ ID NO: 8166 - DNA, 13 bp, Artificial Sequence
  synthetic sequence
catagagatgccc

SEQ ID NO: 8167 - DNA, 13 bp, Artificial Sequence
  synthetic sequence
ttgcccagtcgtt

SEQ ID NO: 8168 - DNA, 13 bp, Artificial Sequence
  synthetic sequence
gacaaggcaaagt

SEQ ID NO: 8169 - DNA, 13 bp, Artificial Sequence
  synthetic sequence
tggaattgaagat

SEQ ID NO: 8170 - DNA, 13 bp, Artificial Sequence
  synthetic sequence
ccatgtcattgaa

SEQ ID NO: 8171 - DNA, 13 bp, Artificial Sequence
  synthetic sequence
cactaatggcatc

SEQ ID NO: 8172 - DNA, 13 bp, Artificial Sequence
  synthetic sequence
agtgaacctgacc

SEQ ID NO: 8173 - DNA, 13 bp, Artificial Sequence
  synthetic sequence
cgacaaatgtgaa

SEQ ID NO: 8174 - DNA, 13 bp, Artificial Sequence
  synthetic sequence
tccgcaggcacat

SEQ ID NO: 8175 - DNA, 13 bp, Artificial Sequence
  synthetic sequence
cactataagggta

SEQ ID NO: 8176 - DNA, 13 bp, Artificial Sequence
  synthetic sequence
tctgggttttgac

SEQ ID NO: 8177 - DNA, 13 bp, Artificial Sequence
  synthetic sequence
tgctggtgcattt

SEQ ID NO: 8178 - DNA, 13 bp, Artificial Sequence
  synthetic sequence
ctagcacgtaagg

SEQ ID NO: 8179 - DNA, 13 bp, Artificial Sequence
  synthetic sequence
tcttccatgctca

SEQ ID NO: 8180 - DNA, 13 bp, Artificial Sequence
  synthetic sequence
ctaacacatcatc

SEQ ID NO: 8181 - DNA, 13 bp, Artificial Sequence
  synthetic sequence
tggtagggtggat

SEQ ID NO: 8182 - DNA, 13 bp, Artificial Sequence
  synthetic sequence
cgaaagcatcacc

SEQ ID NO: 8183 - DNA, 13 bp, Artificial Sequence
  synthetic sequence
gtgccctatagtg

SEQ ID NO: 8184 - DNA, 13 bp, Artificial Sequence
  synthetic sequence
agctgcaataata

SEQ ID NO: 8185 - DNA, 13 bp, Artificial Sequence
  synthetic sequence
attggtatctagc

SEQ ID NO: 8186 - DNA, 13 bp, Artificial Sequence
  synthetic sequence
tcatgtatggaac

SEQ ID NO: 8187 - DNA, 13 bp, Artificial Sequence
  synthetic sequence
tgacacagcctcc

SEQ ID NO: 8188 - DNA, 13 bp, Artificial Sequence
  synthetic sequence
atggtctccactc

SEQ ID NO: 8189 - DNA, 13 bp, Artificial Sequence
  synthetic sequence
tccctcatgggca

SEQ ID NO: 8190 - DNA, 13 bp, Artificial Sequence
  synthetic sequence
gtttcccacatac

SEQ ID NO: 8191 - DNA, 13 bp, Artificial Sequence
  synthetic sequence
ctcatgtgacccg

SEQ ID NO: 8192 - DNA, 13 bp, Artificial Sequence
  synthetic sequence
tagccatatcatt

SEQ ID NO: 8193 - DNA, 13 bp, Artificial Sequence
  synthetic sequence
atttcagatgtgg

SEQ ID NO: 8194 - DNA, 13 bp, Artificial Sequence
  synthetic sequence
gctgggtagtact

SEQ ID NO: 8195 - DNA, 13 bp, Artificial Sequence
  synthetic sequence
agtgtgagttcta

SEQ ID NO: 8196 - DNA, 13 bp, Artificial Sequence
  synthetic sequence
agttgcaatagta

SEQ ID NO: 8197 - DNA, 13 bp, Artificial Sequence
  synthetic sequence
taccattgtgcca

SEQ ID NO: 8198 - DNA, 13 bp, Artificial Sequence
  synthetic sequence
taactcctcttca

SEQ ID NO: 8199 - DNA, 13 bp, Artificial Sequence
  synthetic sequence
tcttccaatgatg

SEQ ID NO: 8200 - DNA, 13 bp, Artificial Sequence
  synthetic sequence
gctgccaaagcca

SEQ ID NO: 8201 - DNA, 13 bp, Artificial Sequence
  synthetic sequence
ggtgacttgtcag

SEQ ID NO: 8202 - DNA, 13 bp, Artificial Sequence
  synthetic sequence
caacgcagccact

SEQ ID NO: 8203 - DNA, 13 bp, Artificial Sequence
  synthetic sequence
ctttgatatagtc

SEQ ID NO: 8204 - DNA, 13 bp, Artificial Sequence
  synthetic sequence
tcgagccaattgc

SEQ ID NO: 8205 - DNA, 13 bp, Artificial Sequence
  synthetic sequence
cactgtatgggta

SEQ ID NO: 8206 - DNA, 13 bp, Artificial Sequence
  synthetic sequence
cactatagccaca

SEQ ID NO: 8207 - DNA, 13 bp, Artificial Sequence
  synthetic sequence
agtttgccaagcg

SEQ ID NO: 8208 - DNA, 13 bp, Artificial Sequence
  synthetic sequence
gagggcatgtgct

SEQ ID NO: 8209 - DNA, 13 bp, Artificial Sequence
  synthetic sequence
ctgtgtctgggca

SEQ ID NO: 8210 - DNA, 13 bp, Artificial Sequence
  synthetic sequence
tctcaacagctcc

SEQ ID NO: 8211 - DNA, 13 bp, Artificial Sequence
  synthetic sequence
cactggcgaagta

SEQ ID NO: 8212 - DNA, 13 bp, Artificial Sequence
  synthetic sequence
tccggggaaacag

SEQ ID NO: 8213 - DNA, 13 bp, Artificial Sequence
  synthetic sequence
tctgtgttttgtg

SEQ ID NO: 8214 - DNA, 13 bp, Artificial Sequence
  synthetic sequence
cattgccaaacat

SEQ ID NO: 8215 - DNA, 13 bp, Artificial Sequence
  synthetic sequence
aaccactggtatg

SEQ ID NO: 8216 - DNA, 13 bp, Artificial Sequence
  synthetic sequence
cgtgttggaccat

SEQ ID NO: 8217 - DNA, 13 bp, Artificial Sequence
  synthetic sequence
ctctattgaggtg

SEQ ID NO: 8218 - DNA, 13 bp, Artificial Sequence
  synthetic sequence
cccaatcattgtg

SEQ ID NO: 8219 - DNA, 13 bp, Artificial Sequence
  synthetic sequence
gttgttttctgtg

SEQ ID NO: 8220 - DNA, 13 bp, Artificial Sequence
  synthetic sequence
atcatgtctgcaa

SEQ ID NO: 8221 - DNA, 13 bp, Artificial Sequence
  synthetic sequence
cacccaatcaggg

SEQ ID NO: 8222 - DNA, 13 bp, Artificial Sequence
  synthetic sequence
caaatgtaaactc

SEQ ID NO: 8223 - DNA, 13 bp, Artificial Sequence
  synthetic sequence
ttgtagataacat

SEQ ID NO: 8224 - DNA, 13 bp, Artificial Sequence
  synthetic sequence
gctggcttctctt

SEQ ID NO: 8225 - DNA, 13 bp, Artificial Sequence
  synthetic sequence
tcttcaggatctt

SEQ ID NO: 8226 - DNA, 13 bp, Artificial Sequence
  synthetic sequence
gactgcatctttt

SEQ ID NO: 8227 - DNA, 13 bp, Artificial Sequence
  synthetic sequence
cagcattagccat

SEQ ID NO: 8228 - DNA, 13 bp, Artificial Sequence
  synthetic sequence
agttggtgtctca

SEQ ID NO: 8229 - DNA, 13 bp, Artificial Sequence
  synthetic sequence
gaataggtaaaca

SEQ ID NO: 8230 - DNA, 13 bp, Artificial Sequence
  synthetic sequence
actcgcccgtttt

SEQ ID NO: 8231 - DNA, 13 bp, Artificial Sequence
  synthetic sequence
gctctgttgcaca

SEQ ID NO: 8232 - DNA, 13 bp, Artificial Sequence
  synthetic sequence
ccagtctggcagt

SEQ ID NO: 8233 - DNA, 13 bp, Artificial Sequence
  synthetic sequence
attgaagatagaa

SEQ ID NO: 8234 - DNA, 13 bp, Artificial Sequence
  synthetic sequence
gctctataatgtg

SEQ ID NO: 8235 - DNA, 13 bp, Artificial Sequence
  synthetic sequence
tgactgtgaccac

SEQ ID NO: 8236 - DNA, 13 bp, Artificial Sequence
  synthetic sequence
ctgggatgatcca

SEQ ID NO: 8237 - DNA, 13 bp, Artificial Sequence
  synthetic sequence
agcacgtactcgg

SEQ ID NO: 8238 - DNA, 13 bp, Artificial Sequence
  synthetic sequence
aatttttcgttgg

SEQ ID NO: 8239 - DNA, 13 bp, Artificial Sequence
  synthetic sequence
gcatcccaccaag

SEQ ID NO: 8240 - DNA, 13 bp, Artificial Sequence
  synthetic sequence
attgtcttcccag

SEQ ID NO: 8241 - DNA, 13 bp, Artificial Sequence
  synthetic sequence
tctaagctcatcc

SEQ ID NO: 8242 - DNA, 13 bp, Artificial Sequence
  synthetic sequence
tggccattcacca

SEQ ID NO: 8243 - DNA, 13 bp, Artificial Sequence
  synthetic sequence
agtctgtcacttc

SEQ ID NO: 8244 - DNA, 13 bp, Artificial Sequence
  synthetic sequence
tttgggttagtct

SEQ ID NO: 8245 - DNA, 13 bp, Artificial Sequence
  synthetic sequence
cacatcatctccg

SEQ ID NO: 8246 - DNA, 13 bp, Artificial Sequence
  synthetic sequence
ttccacctgtaga

SEQ ID NO: 8247 - DNA, 13 bp, Artificial Sequence
  synthetic sequence
tatcagcaatagc

SEQ ID NO: 8248 - DNA, 13 bp, Artificial Sequence
  synthetic sequence
cacacacctggtc

SEQ ID NO: 8249 - DNA, 13 bp, Artificial Sequence
  synthetic sequence
gtgatacagcttc

SEQ ID NO: 8250 - DNA, 13 bp, Artificial Sequence
  synthetic sequence
gtgaactcagcgt

SEQ ID NO: 8251 - DNA, 13 bp, Artificial Sequence
  synthetic sequence
ccagatttctggt

SEQ ID NO: 8252 - DNA, 13 bp, Artificial Sequence
  synthetic sequence
ggtataagtagtg

SEQ ID NO: 8253 - DNA, 13 bp, Artificial Sequence
  synthetic sequence
agggcaaaatcta

SEQ ID NO: 8254 - DNA, 13 bp, Artificial Sequence
  synthetic sequence
tgtttaaaaactc

SEQ ID NO: 8255 - DNA, 13 bp, Artificial Sequence
  synthetic sequence
aactgattagtgc

SEQ ID NO: 8256 - DNA, 13 bp, Artificial Sequence
  synthetic sequence
gacacatttccaa

SEQ ID NO: 8257 - DNA, 13 bp, Artificial Sequence
  synthetic sequence
taggccaccatgt

SEQ ID NO: 8258 - DNA, 13 bp, Artificial Sequence
  synthetic sequence
tgatagctctgtt

SEQ ID NO: 8259 - DNA, 13 bp, Artificial Sequence
  synthetic sequence
cagaccattgagt

SEQ ID NO: 8260 - DNA, 13 bp, Artificial Sequence
  synthetic sequence
ttgagtcctgcac

SEQ ID NO: 8261 - DNA, 13 bp, Artificial Sequence
  synthetic sequence
cagatagtttttc

SEQ ID NO: 8262 - DNA, 13 bp, Artificial Sequence
  synthetic sequence
gaacctgaccact

SEQ ID NO: 8263 - DNA, 13 bp, Artificial Sequence
  synthetic sequence
cttcaatatcaca

SEQ ID NO: 8264 - DNA, 13 bp, Artificial Sequence
  synthetic sequence
tttccactgcacc

SEQ ID NO: 8265 - DNA, 13 bp, Artificial Sequence
  synthetic sequence
ttttcagtcccta

SEQ ID NO: 8266 - DNA, 13 bp, Artificial Sequence
  synthetic sequence
taaagcagggtga

SEQ ID NO: 8267 - DNA, 13 bp, Artificial Sequence
  synthetic sequence
agcaggatcggta

SEQ ID NO: 8268 - DNA, 13 bp, Artificial Sequence
  synthetic sequence
ttccattatgcca

SEQ ID NO: 8269 - DNA, 13 bp, Artificial Sequence
  synthetic sequence
tatgagtgacact

SEQ ID NO: 8270 - DNA, 13 bp, Artificial Sequence
  synthetic sequence
cttttgaagttgg

SEQ ID NO: 8271 - DNA, 13 bp, Artificial Sequence
  synthetic sequence
tacttagagaaca

SEQ ID NO: 8272 - DNA, 13 bp, Artificial Sequence
  synthetic sequence
gctcccattttct

SEQ ID NO: 8273 - DNA, 13 bp, Artificial Sequence
  synthetic sequence
gggaagttataca

SEQ ID NO: 8274 - DNA, 13 bp, Artificial Sequence
  synthetic sequence
cttcattgaagca

SEQ ID NO: 8275 - DNA, 13 bp, Artificial Sequence
  synthetic sequence
atatatggcacta

SEQ ID NO: 8276 - DNA, 13 bp, Artificial Sequence
  synthetic sequence
gttgtgaatgacg

SEQ ID NO: 8277 - DNA, 13 bp, Artificial Sequence
  synthetic sequence
aaatccaacaaat

SEQ ID NO: 8278 - DNA, 13 bp, Artificial Sequence
  synthetic sequence
ccaaacgcatcac

SEQ ID NO: 8279 - DNA, 13 bp, Artificial Sequence
  synthetic sequence
gatcactataacc

SEQ ID NO: 8280 - DNA, 13 bp, Artificial Sequence
  synthetic sequence
cacatcatggaac

SEQ ID NO: 8281 - DNA, 13 bp, Artificial Sequence
  synthetic sequence
tactctctgatta

SEQ ID NO: 8282 - DNA, 13 bp, Artificial Sequence
  synthetic sequence
atcctgagataca

SEQ ID NO: 8283 - DNA, 13 bp, Artificial Sequence
  synthetic sequence
ggattttgacaca

SEQ ID NO: 8284 - DNA, 13 bp, Artificial Sequence
  synthetic sequence
aatatctctcttc

SEQ ID NO: 8285 - DNA, 13 bp, Artificial Sequence
  synthetic sequence
tggatctctttca

SEQ ID NO: 8286 - DNA, 13 bp, Artificial Sequence
  synthetic sequence
ttggcccagtcat

SEQ ID NO: 8287 - DNA, 13 bp, Artificial Sequence
  synthetic sequence
gcaactttcatgg

SEQ ID NO: 8288 - DNA, 13 bp, Artificial Sequence
  synthetic sequence
gcgatgacaaatt

SEQ ID NO: 8289 - DNA, 13 bp, Artificial Sequence
  synthetic sequence
tgttgttttcaga

SEQ ID NO: 8290 - DNA, 13 bp, Artificial Sequence
  synthetic sequence
gcgcttggggatt

SEQ ID NO: 8291 - DNA, 13 bp, Artificial Sequence
  synthetic sequence
aggcgattggtca

SEQ ID NO: 8292 - DNA, 13 bp, Artificial Sequence
  synthetic sequence
aaggacagggcaa

SEQ ID NO: 8293 - DNA, 13 bp, Artificial Sequence
  synthetic sequence
acagcctgtgggt

SEQ ID NO: 8294 - DNA, 13 bp, Artificial Sequence
  synthetic sequence
agtctattgagct

SEQ ID NO: 8295 - DNA, 13 bp, Artificial Sequence
  synthetic sequence
cagcggaaccgac

SEQ ID NO: 8296 - DNA, 13 bp, Artificial Sequence
  synthetic sequence
catacagttcaag

SEQ ID NO: 8297 - DNA, 13 bp, Artificial Sequence
  synthetic sequence
ttaccatatagct

SEQ ID NO: 8298 - DNA, 13 bp, Artificial Sequence
  synthetic sequence
cgatgagtcaccg

SEQ ID NO: 8299 - DNA, 13 bp, Artificial Sequence
  synthetic sequence
tcatgacaccagc

SEQ ID NO: 8300 - DNA, 13 bp, Artificial Sequence
  synthetic sequence
attagagacaatt

SEQ ID NO: 8301 - DNA, 13 bp, Artificial Sequence
  synthetic sequence
gctggtatcaaac

SEQ ID NO: 8302 - DNA, 13 bp, Artificial Sequence
  synthetic sequence
aacaccagcaagt

SEQ ID NO: 8303 - DNA, 13 bp, Artificial Sequence
  synthetic sequence
ctttgacatgaac

SEQ ID NO: 8304 - DNA, 13 bp, Artificial Sequence
  synthetic sequence
actgtgtgtggga

SEQ ID NO: 8305 - DNA, 13 bp, Artificial Sequence
  synthetic sequence
tccaatactttgc

SEQ ID NO: 8306 - DNA, 13 bp, Artificial Sequence
  synthetic sequence
caccagggcttac

SEQ ID NO: 8307 - DNA, 13 bp, Artificial Sequence
  synthetic sequence
agacttaaacaac

SEQ ID NO: 8308 - DNA, 13 bp, Artificial Sequence
  synthetic sequence
acttcaatgatga

SEQ ID NO: 8309 - DNA, 13 bp, Artificial Sequence
  synthetic sequence
aattcaggatgat

SEQ ID NO: 8310 - DNA, 13 bp, Artificial Sequence
  synthetic sequence
gcattctgttcac

SEQ ID NO: 8311 - DNA, 13 bp, Artificial Sequence
  synthetic sequence
acgaatatgagga

SEQ ID NO: 8312 - DNA, 13 bp, Artificial Sequence
  synthetic sequence
gctcagtgtactc

SEQ ID NO: 8313 - DNA, 13 bp, Artificial Sequence
  synthetic sequence
agaactaccattc

SEQ ID NO: 8314 - DNA, 13 bp, Artificial Sequence
  synthetic sequence
atgtcagtcgggc

SEQ ID NO: 8315 - DNA, 13 bp, Artificial Sequence
  synthetic sequence
gaggaccaaccga

SEQ ID NO: 8316 - DNA, 13 bp, Artificial Sequence
  synthetic sequence
aacaatcaggggc

SEQ ID NO: 8317 - DNA, 13 bp, Artificial Sequence
  synthetic sequence
gctgccctcttgt

SEQ ID NO: 8318 - DNA, 13 bp, Artificial Sequence
  synthetic sequence
ctgggccaaccat

SEQ ID NO: 8319 - DNA, 13 bp, Artificial Sequence
  synthetic sequence
ttatgcccatgaa

SEQ ID NO: 8320 - DNA, 13 bp, Artificial Sequence
  synthetic sequence
catttggtaatct

SEQ ID NO: 8321 - DNA, 13 bp, Artificial Sequence
  synthetic sequence
atgcttgcaaggg

SEQ ID NO: 8322 - DNA, 13 bp, Artificial Sequence
  synthetic sequence
acaaactacattg

SEQ ID NO: 8323 - DNA, 13 bp, Artificial Sequence
  synthetic sequence
gacatctcatagc

SEQ ID NO: 8324 - DNA, 13 bp, Artificial Sequence
  synthetic sequence
caagagcaggcca

SEQ ID NO: 8325 - DNA, 13 bp, Artificial Sequence
  synthetic sequence
gttcggccatggc

SEQ ID NO: 8326 - DNA, 13 bp, Artificial Sequence
  synthetic sequence
tatgctgaatggg

SEQ ID NO: 8327 - DNA, 13 bp, Artificial Sequence
  synthetic sequence
tgagcattggcaa

SEQ ID NO: 8328 - DNA, 13 bp, Artificial Sequence
  synthetic sequence
tttgggacgtggg

SEQ ID NO: 8329 - DNA, 13 bp, Artificial Sequence
  synthetic sequence
tccaccaggtctt

SEQ ID NO: 8330 - DNA, 13 bp, Artificial Sequence
  synthetic sequence
actgaaccaatga

SEQ ID NO: 8331 - DNA, 13 bp, Artificial Sequence
  synthetic sequence
ggaatgagaagtt

SEQ ID NO: 8332 - DNA, 13 bp, Artificial Sequence
  synthetic sequence
agcacggtgaaaa

SEQ ID NO: 8333 - DNA, 13 bp, Artificial Sequence
  synthetic sequence
gtgtcacaatatt

SEQ ID NO: 8334 - DNA, 13 bp, Artificial Sequence
  synthetic sequence
agaaggcaaagaa

SEQ ID NO: 8335 - DNA, 13 bp, Artificial Sequence
  synthetic sequence
gggcagaacatgc

SEQ ID NO: 8336 - DNA, 13 bp, Artificial Sequence
  synthetic sequence
tagtagtgtgtgt

SEQ ID NO: 8337 - DNA, 13 bp, Artificial Sequence
  synthetic sequence
gcaccaataatag

SEQ ID NO: 8338 - DNA, 13 bp, Artificial Sequence
  synthetic sequence
tctaagaagacta

SEQ ID NO: 8339 - DNA, 13 bp, Artificial Sequence
  synthetic sequence
ctgctcacgcggt

SEQ ID NO: 8340 - DNA, 13 bp, Artificial Sequence
  synthetic sequence
agataccaatccc

SEQ ID NO: 8341 - DNA, 13 bp, Artificial Sequence
  synthetic sequence
tactcgagtgttt

SEQ ID NO: 8342 - DNA, 13 bp, Artificial Sequence
  synthetic sequence
actccaccataac

SEQ ID NO: 8343 - DNA, 13 bp, Artificial Sequence
  synthetic sequence
tacaatcatagac

SEQ ID NO: 8344 - DNA, 13 bp, Artificial Sequence
  synthetic sequence
taccagataaagt

SEQ ID NO: 8345 - DNA, 13 bp, Artificial Sequence
  synthetic sequence
aaagatgagctca

SEQ ID NO: 8346 - DNA, 13 bp, Artificial Sequence
  synthetic sequence
tgttctggtacca

SEQ ID NO: 8347 - DNA, 13 bp, Artificial Sequence
  synthetic sequence
caaaatgttggag

SEQ ID NO: 8348 - DNA, 13 bp, Artificial Sequence
  synthetic sequence
atcagccttagta

SEQ ID NO: 8349 - DNA, 13 bp, Artificial Sequence
  synthetic sequence
agtttgcggacaa

SEQ ID NO: 8350 - DNA, 13 bp, Artificial Sequence
  synthetic sequence
aacgggagtgtac

SEQ ID NO: 8351 - DNA, 13 bp, Artificial Sequence
  synthetic sequence
agatatcatgatt

SEQ ID NO: 8352 - DNA, 13 bp, Artificial Sequence
  synthetic sequence
cgtgatctcctgt

SEQ ID NO: 8353 - DNA, 13 bp, Artificial Sequence
  synthetic sequence
tatgtgagcaagt

SEQ ID NO: 8354 - DNA, 13 bp, Artificial Sequence
  synthetic sequence
gacgtttgtcata

SEQ ID NO: 8355 - DNA, 13 bp, Artificial Sequence
  synthetic sequence
acaacgtcaccct

SEQ ID NO: 8356 - DNA, 13 bp, Artificial Sequence
  synthetic sequence
gggcacgctatat

SEQ ID NO: 8357 - DNA, 13 bp, Artificial Sequence
  synthetic sequence
tattttccaagta

SEQ ID NO: 8358 - DNA, 13 bp, Artificial Sequence
  synthetic sequence
ctagcggcaattc

SEQ ID NO: 8359 - DNA, 13 bp, Artificial Sequence
  synthetic sequence
ctgtcaggctatt

SEQ ID NO: 8360 - DNA, 13 bp, Artificial Sequence
  synthetic sequence
ccgatcaacagtc

SEQ ID NO: 8361 - DNA, 13 bp, Artificial Sequence
  synthetic sequence
accgtgggtacag

SEQ ID NO: 8362 - DNA, 13 bp, Artificial Sequence
  synthetic sequence
ccatgccgcaata

SEQ ID NO: 8363 - DNA, 13 bp, Artificial Sequence
  synthetic sequence
gtctccttgttct

SEQ ID NO: 8364 - DNA, 13 bp, Artificial Sequence
  synthetic sequence
gttttcaaggtgc

SEQ ID NO: 8365 - DNA, 13 bp, Artificial Sequence
  synthetic sequence
cattgcggacctg

SEQ ID NO: 8366 - DNA, 13 bp, Artificial Sequence
  synthetic sequence
gaaggagaaaacg

SEQ ID NO: 8367 - DNA, 13 bp, Artificial Sequence
  synthetic sequence
gacctatgtgaag

SEQ ID NO: 8368 - DNA, 13 bp, Artificial Sequence
  synthetic sequence
gtaacttagaagc

SEQ ID NO: 8369 - DNA, 13 bp, Artificial Sequence
  synthetic sequence
ccaccaccaccag

SEQ ID NO: 8370 - DNA, 13 bp, Artificial Sequence
  synthetic sequence
gccatgccacaat

SEQ ID NO: 8371 - DNA, 13 bp, Artificial Sequence
  synthetic sequence
attcaatgatcaa

SEQ ID NO: 8372 - DNA, 13 bp, Artificial Sequence
  synthetic sequence
aattactacaagg

SEQ ID NO: 8373 - DNA, 13 bp, Artificial Sequence
  synthetic sequence
atgtgaacacaca

SEQ ID NO: 8374 - DNA, 13 bp, Artificial Sequence
  synthetic sequence
tccagggcgcata

SEQ ID NO: 8375 - DNA, 13 bp, Artificial Sequence
  synthetic sequence
tacaatcacagac

SEQ ID NO: 8376 - DNA, 13 bp, Artificial Sequence
  synthetic sequence
gatgcagtgtatg

SEQ ID NO: 8377 - DNA, 13 bp, Artificial Sequence
  synthetic sequence
atatgcagtatca

SEQ ID NO: 8378 - DNA, 13 bp, Artificial Sequence
  synthetic sequence
ttgttggctttgc

SEQ ID NO: 8379 - DNA, 13 bp, Artificial Sequence
  synthetic sequence
tgtgcatcaagga

SEQ ID NO: 8380 - DNA, 13 bp, Artificial Sequence
  synthetic sequence
ggccatgatgaag

SEQ ID NO: 8381 - DNA, 13 bp, Artificial Sequence
  synthetic sequence
aactcacctttgt

SEQ ID NO: 8382 - DNA, 13 bp, Artificial Sequence
  synthetic sequence
gatgataaagtca

SEQ ID NO: 8383 - DNA, 13 bp, Artificial Sequence
  synthetic sequence
atgtgtctttgtt

SEQ ID NO: 8384 - DNA, 13 bp, Artificial Sequence
  synthetic sequence
gagtgtgcaaacg

SEQ ID NO: 8385 - DNA, 13 bp, Artificial Sequence
  synthetic sequence
agagagacatcct

SEQ ID NO: 8386 - DNA, 13 bp, Artificial Sequence
  synthetic sequence
ggtaagtttttgc

SEQ ID NO: 8387 - DNA, 13 bp, Artificial Sequence
  synthetic sequence
ggcgctggctcaa

SEQ ID NO: 8388 - DNA, 13 bp, Artificial Sequence
  synthetic sequence
agatgactaatgc

SEQ ID NO: 8389 - DNA, 13 bp, Artificial Sequence
  synthetic sequence
tgagtatcggtaa

SEQ ID NO: 8390 - DNA, 13 bp, Artificial Sequence
  synthetic sequence
attggcttggcac

SEQ ID NO: 8391 - DNA, 13 bp, Artificial Sequence
  synthetic sequence
aatacctgtaatg

SEQ ID NO: 8392 - DNA, 13 bp, Artificial Sequence
  synthetic sequence
caagggtgcctct

SEQ ID NO: 8393 - DNA, 13 bp, Artificial Sequence
  synthetic sequence
aggattcacaaat

SEQ ID NO: 8394 - DNA, 13 bp, Artificial Sequence
  synthetic sequence
gggagctagtagc

SEQ ID NO: 8395 - DNA, 13 bp, Artificial Sequence
  synthetic sequence
tagatttgcttct

SEQ ID NO: 8396 - DNA, 13 bp, Artificial Sequence
  synthetic sequence
gttgacgactatg

SEQ ID NO: 8397 - DNA, 13 bp, Artificial Sequence
  synthetic sequence
ctcgtgaagatca

SEQ ID NO: 8398 - DNA, 13 bp, Artificial Sequence
  synthetic sequence
cttctaaataaag

SEQ ID NO: 8399 - DNA, 13 bp, Artificial Sequence
  synthetic sequence
ccctgtcatgccc

SEQ ID NO: 8400 - DNA, 13 bp, Artificial Sequence
  synthetic sequence
agctcaatcgaaa

SEQ ID NO: 8401 - DNA, 13 bp, Artificial Sequence
  synthetic sequence
cgcaaatggacaa

SEQ ID NO: 8402 - DNA, 13 bp, Artificial Sequence
  synthetic sequence
ggatgattgcata

SEQ ID NO: 8403 - DNA, 13 bp, Artificial Sequence
  synthetic sequence
cagtccagctgtg

SEQ ID NO: 8404 - DNA, 13 bp, Artificial Sequence
  synthetic sequence
caattttcccgca

SEQ ID NO: 8405 - DNA, 13 bp, Artificial Sequence
  synthetic sequence
aaccaattcagaa

SEQ ID NO: 8406 - DNA, 13 bp, Artificial Sequence
  synthetic sequence
cttcgcaaagtta

SEQ ID NO: 8407 - DNA, 13 bp, Artificial Sequence
  synthetic sequence
tcagaatgctgag

SEQ ID NO: 8408 - DNA, 13 bp, Artificial Sequence
  synthetic sequence
attggcagagttg

SEQ ID NO: 8409 - DNA, 13 bp, Artificial Sequence
  synthetic sequence
actttgctcacta

SEQ ID NO: 8410 - DNA, 13 bp, Artificial Sequence
  synthetic sequence
gagacaaattaca

SEQ ID NO: 8411 - DNA, 13 bp, Artificial Sequence
  synthetic sequence
ccggaccaactat

SEQ ID NO: 8412 - DNA, 13 bp, Artificial Sequence
  synthetic sequence
agattgagaagca

SEQ ID NO: 8413 - DNA, 13 bp, Artificial Sequence
  synthetic sequence
tacaagacattcc

SEQ ID NO: 8414 - DNA, 13 bp, Artificial Sequence
  synthetic sequence
atgggaggcgatg

SEQ ID NO: 8415 - DNA, 13 bp, Artificial Sequence
  synthetic sequence
ctccaccattact

SEQ ID NO: 8416 - DNA, 13 bp, Artificial Sequence
  synthetic sequence
acagaaccagtta

SEQ ID NO: 8417 - DNA, 13 bp, Artificial Sequence
  synthetic sequence
cttcaagaaacaa

SEQ ID NO: 8418 - DNA, 13 bp, Artificial Sequence
  synthetic sequence
cggtgcaaaatat

SEQ ID NO: 8419 - DNA, 13 bp, Artificial Sequence
  synthetic sequence
tttatatcccagg

SEQ ID NO: 8420 - DNA, 13 bp, Artificial Sequence
  synthetic sequence
tgatggtgattcc

SEQ ID NO: 8421 - DNA, 13 bp, Artificial Sequence
  synthetic sequence
gccatccagttca

SEQ ID NO: 8422 - DNA, 13 bp, Artificial Sequence
  synthetic sequence
gaccaactaactc

SEQ ID NO: 8423 - DNA, 13 bp, Artificial Sequence
  synthetic sequence
aacatgggaaccc

SEQ ID NO: 8424 - DNA, 13 bp, Artificial Sequence
  synthetic sequence
tgtacagccaaaa

SEQ ID NO: 8425 - DNA, 13 bp, Artificial Sequence
  synthetic sequence
atgcttttggttc

SEQ ID NO: 8426 - DNA, 13 bp, Artificial Sequence
  synthetic sequence
gtacacagcaacc

SEQ ID NO: 8427 - DNA, 13 bp, Artificial Sequence
  synthetic sequence
ttcaccagggatg

SEQ ID NO: 8428 - DNA, 13 bp, Artificial Sequence
  synthetic sequence
gctgcaaaggagt

SEQ ID NO: 8429 - DNA, 13 bp, Artificial Sequence
  synthetic sequence
cgccacatgtaga

SEQ ID NO: 8430 - DNA, 13 bp, Artificial Sequence
  synthetic sequence
cagggatgcccaa

SEQ ID NO: 8431 - DNA, 13 bp, Artificial Sequence
  synthetic sequence
agcagtgtatgtg

SEQ ID NO: 8432 - DNA, 13 bp, Artificial Sequence
  synthetic sequence
catgtgaaaaatt

SEQ ID NO: 8433 - DNA, 13 bp, Artificial Sequence
  synthetic sequence
gaaaagttaaaca

SEQ ID NO: 8434 - DNA, 13 bp, Artificial Sequence
  synthetic sequence
taatagtggttag

SEQ ID NO: 8435 - DNA, 13 bp, Artificial Sequence
  synthetic sequence
caaacagctcccc

SEQ ID NO: 8436 - DNA, 13 bp, Artificial Sequence
  synthetic sequence
ccacttaaacacg

SEQ ID NO: 8437 - DNA, 13 bp, Artificial Sequence
  synthetic sequence
atcaacccaccca

SEQ ID NO: 8438 - DNA, 13 bp, Artificial Sequence
  synthetic sequence
accagtcccacgt

SEQ ID NO: 8439 - DNA, 13 bp, Artificial Sequence
  synthetic sequence
ttcccaaacatgt

SEQ ID NO: 8440 - DNA, 13 bp, Artificial Sequence
  synthetic sequence
acgtatctctatt

SEQ ID NO: 8441 - DNA, 13 bp, Artificial Sequence
  synthetic sequence
cactgctgaaact

SEQ ID NO: 8442 - DNA, 13 bp, Artificial Sequence
  synthetic sequence
aaatcagtggata

SEQ ID NO: 8443 - DNA, 13 bp, Artificial Sequence
  synthetic sequence
aggcattaaaaag

SEQ ID NO: 8444 - DNA, 13 bp, Artificial Sequence
  synthetic sequence
agctctcctcaag

SEQ ID NO: 8445 - DNA, 13 bp, Artificial Sequence
  synthetic sequence
tacgtgtggcaaa

SEQ ID NO: 8446 - DNA, 13 bp, Artificial Sequence
  synthetic sequence
ctaacattgtggt

SEQ ID NO: 8447 - DNA, 13 bp, Artificial Sequence
  synthetic sequence
aacatcaactact

SEQ ID NO: 8448 - DNA, 13 bp, Artificial Sequence
  synthetic sequence
aaacatgttagca

SEQ ID NO: 8449 - DNA, 13 bp, Artificial Sequence
  synthetic sequence
caaccagagcagg

SEQ ID NO: 8450 - DNA, 13 bp, Artificial Sequence
  synthetic sequence
accagtggatcaa

SEQ ID NO: 8451 - DNA, 13 bp, Artificial Sequence
  synthetic sequence
aaaacaaaattgg

SEQ ID NO: 8452 - DNA, 13 bp, Artificial Sequence
  synthetic sequence
gtcttccaccagg

SEQ ID NO: 8453 - DNA, 13 bp, Artificial Sequence
  synthetic sequence
ggtggcgttctca

SEQ ID NO: 8454 - DNA, 13 bp, Artificial Sequence
  synthetic sequence
cacacaaggagac

SEQ ID NO: 8455 - DNA, 13 bp, Artificial Sequence
  synthetic sequence
gcttaaacagaaa

SEQ ID NO: 8456 - DNA, 13 bp, Artificial Sequence
  synthetic sequence
tgttcacttcccc

SEQ ID NO: 8457 - DNA, 13 bp, Artificial Sequence
  synthetic sequence
aggaactcaagca

SEQ ID NO: 8458 - DNA, 13 bp, Artificial Sequence
  synthetic sequence
tgcaacttagaag

SEQ ID NO: 8459 - DNA, 13 bp, Artificial Sequence
  synthetic sequence
tcaccaaccagat

SEQ ID NO: 8460 - DNA, 13 bp, Artificial Sequence
  synthetic sequence
aacttcccctctt

SEQ ID NO: 8461 - DNA, 13 bp, Artificial Sequence
  synthetic sequence
tggagaggacact

SEQ ID NO: 8462 - DNA, 13 bp, Artificial Sequence
  synthetic sequence
gcgtctgctgcgt

SEQ ID NO: 8463 - DNA, 13 bp, Artificial Sequence
  synthetic sequence
ctatgccgcaatt

SEQ ID NO: 8464 - DNA, 13 bp, Artificial Sequence
  synthetic sequence
caggaaagtgcta

SEQ ID NO: 8465 - DNA, 13 bp, Artificial Sequence
  synthetic sequence
accccagacaaaa

SEQ ID NO: 8466 - DNA, 13 bp, Artificial Sequence
  synthetic sequence
ttgtgtcaaaacc

SEQ ID NO: 8467 - DNA, 13 bp, Artificial Sequence
  synthetic sequence
agagaacactatt

SEQ ID NO: 8468 - DNA, 13 bp, Artificial Sequence
  synthetic sequence
ctggtgatcgtag

SEQ ID NO: 8469 - DNA, 13 bp, Artificial Sequence
  synthetic sequence
gtgaatgataaaa

SEQ ID NO: 8470 - DNA, 13 bp, Artificial Sequence
  synthetic sequence
gttacatttgtta

SEQ ID NO: 8471 - DNA, 13 bp, Artificial Sequence
  synthetic sequence
gggttcatcacct

SEQ ID NO: 8472 - DNA, 13 bp, Artificial Sequence
  synthetic sequence
tggtcccagtaat

SEQ ID NO: 8473 - DNA, 13 bp, Artificial Sequence
  synthetic sequence
ctatgaggaattc

SEQ ID NO: 8474 - DNA, 13 bp, Artificial Sequence
  synthetic sequence
gggagtacaacca

SEQ ID NO: 8475 - DNA, 13 bp, Artificial Sequence
  synthetic sequence
attaagcaagaaa

SEQ ID NO: 8476 - DNA, 13 bp, Artificial Sequence
  synthetic sequence
gtctagccggtca

SEQ ID NO: 8477 - DNA, 13 bp, Artificial Sequence
  synthetic sequence
atggcgacgatgt

SEQ ID NO: 8478 - DNA, 13 bp, Artificial Sequence
  synthetic sequence
tacacacacaagg

SEQ ID NO: 8479 - DNA, 13 bp, Artificial Sequence
  synthetic sequence
aatccagttgtgt

SEQ ID NO: 8480 - DNA, 13 bp, Artificial Sequence
  synthetic sequence
tggatcaatctac

SEQ ID NO: 8481 - DNA, 13 bp, Artificial Sequence
  synthetic sequence
aggacataatggt

SEQ ID NO: 8482 - DNA, 13 bp, Artificial Sequence
  synthetic sequence
atatcagcattag

SEQ ID NO: 8483 - DNA, 13 bp, Artificial Sequence
  synthetic sequence
gggagttgtcgga

SEQ ID NO: 8484 - DNA, 13 bp, Artificial Sequence
  synthetic sequence
gcaaggcagttca

SEQ ID NO: 8485 - DNA, 13 bp, Artificial Sequence
  synthetic sequence
taatgctagatgg

SEQ ID NO: 8486 - DNA, 13 bp, Artificial Sequence
  synthetic sequence
aagtcaagcaaca

SEQ ID NO: 8487 - DNA, 13 bp, Artificial Sequence
  synthetic sequence
cccatttgccaaa

SEQ ID NO: 8488 - DNA, 13 bp, Artificial Sequence
  synthetic sequence
aactctgaacaaa

SEQ ID NO: 8489 - DNA, 13 bp, Artificial Sequence
  synthetic sequence
gccggaaatgaac

SEQ ID NO: 8490 - DNA, 13 bp, Artificial Sequence
  synthetic sequence
cagcgaaaagctt

SEQ ID NO: 8491 - DNA, 13 bp, Artificial Sequence
  synthetic sequence
cacatgtcttgct

SEQ ID NO: 8492 - DNA, 13 bp, Artificial Sequence
  synthetic sequence
agacacttaattt

SEQ ID NO: 8493 - DNA, 13 bp, Artificial Sequence
  synthetic sequence
aaacttccacgtt

SEQ ID NO: 8494 - DNA, 13 bp, Artificial Sequence
  synthetic sequence
gaagcgttatgca

SEQ ID NO: 8495 - DNA, 13 bp, Artificial Sequence
  synthetic sequence
cctgttatgccaa

SEQ ID NO: 8496 - DNA, 13 bp, Artificial Sequence
  synthetic sequence
ccgcgtttgtgtc

SEQ ID NO: 8497 - DNA, 13 bp, Artificial Sequence
  synthetic sequence
ttatatgggatgt

SEQ ID NO: 8498 - DNA, 13 bp, Artificial Sequence
  synthetic sequence
ccgtggatgacta

SEQ ID NO: 8499 - DNA, 13 bp, Artificial Sequence
  synthetic sequence
atgcctgcaaagg

SEQ ID NO: 8500 - DNA, 13 bp, Artificial Sequence
  synthetic sequence
tatcctattcaca

SEQ ID NO: 8501 - DNA, 13 bp, Artificial Sequence
  synthetic sequence
tatttcaatgatg

SEQ ID NO: 8502 - DNA, 13 bp, Artificial Sequence
  synthetic sequence
aatgactacgtgt

SEQ ID NO: 8503 - DNA, 13 bp, Artificial Sequence
  synthetic sequence
gtggagaactacg

SEQ ID NO: 8504 - DNA, 13 bp, Artificial Sequence
  synthetic sequence
tttgggcaaaaca

SEQ ID NO: 8505 - DNA, 13 bp, Artificial Sequence
  synthetic sequence
gttccttctagcc

SEQ ID NO: 8506 - DNA, 13 bp, Artificial Sequence
  synthetic sequence
caacaatgtgaac

SEQ ID NO: 8507 - DNA, 13 bp, Artificial Sequence
  synthetic sequence
ggtaacgcctaca

SEQ ID NO: 8508 - DNA, 13 bp, Artificial Sequence
  synthetic sequence
ctgatgactatgg

SEQ ID NO: 8509 - DNA, 13 bp, Artificial Sequence
  synthetic sequence
cttaacattgttt

SEQ ID NO: 8510 - DNA, 13 bp, Artificial Sequence
  synthetic sequence
cagggtattcgag

SEQ ID NO: 8511 - DNA, 13 bp, Artificial Sequence
  synthetic sequence
acgaagtcacctg

SEQ ID NO: 8512 - DNA, 13 bp, Artificial Sequence
  synthetic sequence
cgtgcacaattat

SEQ ID NO: 8513 - DNA, 13 bp, Artificial Sequence
  synthetic sequence
caggtgtttatta

SEQ ID NO: 8514 - DNA, 13 bp, Artificial Sequence
  synthetic sequence
gtactccctacca

SEQ ID NO: 8515 - DNA, 13 bp, Artificial Sequence
  synthetic sequence
gcgcaggaagtgg

SEQ ID NO: 8516 - DNA, 13 bp, Artificial Sequence
  synthetic sequence
taccagtgatgtt

SEQ ID NO: 8517 - DNA, 13 bp, Artificial Sequence
  synthetic sequence
ccaccaaggctgt

SEQ ID NO: 8518 - DNA, 13 bp, Artificial Sequence
  synthetic sequence
tgtacaacttccc

SEQ ID NO: 8519 - DNA, 13 bp, Artificial Sequence
  synthetic sequence
agttcagagacat

SEQ ID NO: 8520 - DNA, 13 bp, Artificial Sequence
  synthetic sequence
catggggaccata

SEQ ID NO: 8521 - DNA, 13 bp, Artificial Sequence
  synthetic sequence
atccttatgaatg

SEQ ID NO: 8522 - DNA, 13 bp, Artificial Sequence
  synthetic sequence
ttgtgtgtgggaa

SEQ ID NO: 8523 - DNA, 13 bp, Artificial Sequence
  synthetic sequence
agcgttttccacc

SEQ ID NO: 8524 - DNA, 13 bp, Artificial Sequence
  synthetic sequence
cctttcctgagca

SEQ ID NO: 8525 - DNA, 13 bp, Artificial Sequence
  synthetic sequence
gcccatgaaagac

SEQ ID NO: 8526 - DNA, 13 bp, Artificial Sequence
  synthetic sequence
gcggagaatttac

SEQ ID NO: 8527 - DNA, 13 bp, Artificial Sequence
  synthetic sequence
cggacacccaaag

SEQ ID NO: 8528 - DNA, 13 bp, Artificial Sequence
  synthetic sequence
agccgcattcagg

SEQ ID NO: 8529 - DNA, 13 bp, Artificial Sequence
  synthetic sequence
atactcagtccgg

SEQ ID NO: 8530 - DNA, 13 bp, Artificial Sequence
  synthetic sequence
ctgacatgggcat

SEQ ID NO: 8531 - DNA, 13 bp, Artificial Sequence
  synthetic sequence
tagggttaagcca

SEQ ID NO: 8532 - DNA, 13 bp, Artificial Sequence
  synthetic sequence
tagtattcactct

SEQ ID NO: 8533 - DNA, 13 bp, Artificial Sequence
  synthetic sequence
ggtgtgttgatga

SEQ ID NO: 8534 - DNA, 13 bp, Artificial Sequence
  synthetic sequence
caaaatctacact

SEQ ID NO: 8535 - DNA, 13 bp, Artificial Sequence
  synthetic sequence
ggccttgcacttt

SEQ ID NO: 8536 - DNA, 13 bp, Artificial Sequence
  synthetic sequence
acaggtgatggga

SEQ ID NO: 8537 - DNA, 13 bp, Artificial Sequence
  synthetic sequence
atgctgcctgacc

SEQ ID NO: 8538 - DNA, 13 bp, Artificial Sequence
  synthetic sequence
aaatacctcttta

SEQ ID NO: 8539 - DNA, 13 bp, Artificial Sequence
  synthetic sequence
acccactagtgat

SEQ ID NO: 8540 - DNA, 13 bp, Artificial Sequence
  synthetic sequence
tcaggaaccaacc

SEQ ID NO: 8541 - DNA, 13 bp, Artificial Sequence
  synthetic sequence
actccctgttcca

SEQ ID NO: 8542 - DNA, 13 bp, Artificial Sequence
  synthetic sequence
caccaacatggat

SEQ ID NO: 8543 - DNA, 13 bp, Artificial Sequence
  synthetic sequence
aagtgatctgggt

SEQ ID NO: 8544 - DNA, 13 bp, Artificial Sequence
  synthetic sequence
ttgctccaaaaga

SEQ ID NO: 8545 - DNA, 13 bp, Artificial Sequence
  synthetic sequence
ccacctgtcatag

SEQ ID NO: 8546 - DNA, 13 bp, Artificial Sequence
  synthetic sequence
ccctcggtccaaa

SEQ ID NO: 8547 - DNA, 13 bp, Artificial Sequence
  synthetic sequence
ctgctggttcttt

SEQ ID NO: 8548 - DNA, 13 bp, Artificial Sequence
  synthetic sequence
tgagcgcacgtga

SEQ ID NO: 8549 - DNA, 13 bp, Artificial Sequence
  synthetic sequence
acctccacttcct

SEQ ID NO: 8550 - DNA, 13 bp, Artificial Sequence
  synthetic sequence
gcactcgttgtta

SEQ ID NO: 8551 - DNA, 13 bp, Artificial Sequence
  synthetic sequence
ggtgtgccaccta

SEQ ID NO: 8552 - DNA, 13 bp, Artificial Sequence
  synthetic sequence
atgattccagcca

SEQ ID NO: 8553 - DNA, 13 bp, Artificial Sequence
  synthetic sequence
tgcattatacacc

SEQ ID NO: 8554 - DNA, 13 bp, Artificial Sequence
  synthetic sequence
ggcaagcaaacca

SEQ ID NO: 8555 - DNA, 13 bp, Artificial Sequence
  synthetic sequence
taattttgatctc

SEQ ID NO: 8556 - DNA, 13 bp, Artificial Sequence
  synthetic sequence
gtcgtctgatgtc

SEQ ID NO: 8557 - DNA, 13 bp, Artificial Sequence
  synthetic sequence
ctttgacatgctt

SEQ ID NO: 8558 - DNA, 13 bp, Artificial Sequence
  synthetic sequence
actgggacgcttc

SEQ ID NO: 8559 - DNA, 13 bp, Artificial Sequence
  synthetic sequence
gggctagtgtggc

SEQ ID NO: 8560 - DNA, 13 bp, Artificial Sequence
  synthetic sequence
ctgagcgaaacac

SEQ ID NO: 8561 - DNA, 13 bp, Artificial Sequence
  synthetic sequence
gtctcatgtgccc

SEQ ID NO: 8562 - DNA, 13 bp, Artificial Sequence
  synthetic sequence
cttcagctgcgta

SEQ ID NO: 8563 - DNA, 13 bp, Artificial Sequence
  synthetic sequence
tacttgtccatac

SEQ ID NO: 8564 - DNA, 13 bp, Artificial Sequence
  synthetic sequence
cgtagtggtccac

SEQ ID NO: 8565 - DNA, 13 bp, Artificial Sequence
  synthetic sequence
tcggtgactagca

SEQ ID NO: 8566 - DNA, 13 bp, Artificial Sequence
  synthetic sequence
ttttccctgacct

SEQ ID NO: 8567 - DNA, 13 bp, Artificial Sequence
  synthetic sequence
cattgcatgctga

SEQ ID NO: 8568 - DNA, 13 bp, Artificial Sequence
  synthetic sequence
agttccccacata

SEQ ID NO: 8569 - DNA, 13 bp, Artificial Sequence
  synthetic sequence
ccggtagtgtgtt

SEQ ID NO: 8570 - DNA, 13 bp, Artificial Sequence
  synthetic sequence
cttccaccaccat

SEQ ID NO: 8571 - DNA, 13 bp, Artificial Sequence
  synthetic sequence
gttcctggtcact

SEQ ID NO: 8572 - DNA, 13 bp, Artificial Sequence
  synthetic sequence
tctgacacggttg

SEQ ID NO: 8573 - DNA, 13 bp, Artificial Sequence
  synthetic sequence
ctcagctatttcc

SEQ ID NO: 8574 - DNA, 13 bp, Artificial Sequence
  synthetic sequence
atccctttgtaca

SEQ ID NO: 8575 - DNA, 13 bp, Artificial Sequence
  synthetic sequence
aaagtacacgcat

SEQ ID NO: 8576 - DNA, 13 bp, Artificial Sequence
  synthetic sequence
tgggacgtacgtg

SEQ ID NO: 8577 - DNA, 13 bp, Artificial Sequence
  synthetic sequence
ctggacgcctcaa

SEQ ID NO: 8578 - DNA, 13 bp, Artificial Sequence
  synthetic sequence
ctggctataatat

SEQ ID NO: 8579 - DNA, 13 bp, Artificial Sequence
  synthetic sequence
tagtagtggtaac

SEQ ID NO: 8580 - DNA, 13 bp, Artificial Sequence
  synthetic sequence
caccttaggatac

SEQ ID NO: 8581 - DNA, 13 bp, Artificial Sequence
  synthetic sequence
atacttgcgttcc

SEQ ID NO: 8582 - DNA, 13 bp, Artificial Sequence
  synthetic sequence
gattggctgagtt

SEQ ID NO: 8583 - DNA, 13 bp, Artificial Sequence
  synthetic sequence
tggtgtgttagga

SEQ ID NO: 8584 - DNA, 13 bp, Artificial Sequence
  synthetic sequence
cccttaccagctt

SEQ ID NO: 8585 - DNA, 13 bp, Artificial Sequence
  synthetic sequence
cgttcctggaaaa

SEQ ID NO: 8586 - DNA, 13 bp, Artificial Sequence
  synthetic sequence
tggtgtatggcat

SEQ ID NO: 8587 - DNA, 13 bp, Artificial Sequence
  synthetic sequence
gtaaagaattcta

SEQ ID NO: 8588 - DNA, 13 bp, Artificial Sequence
  synthetic sequence
actggatggggtg

SEQ ID NO: 8589 - DNA, 13 bp, Artificial Sequence
  synthetic sequence
gcatcaacccttt

SEQ ID NO: 8590 - DNA, 13 bp, Artificial Sequence
  synthetic sequence
gttatcgcgtctt

SEQ ID NO: 8591 - DNA, 13 bp, Artificial Sequence
  synthetic sequence
taagtggtataaa

SEQ ID NO: 8592 - DNA, 13 bp, Artificial Sequence
  synthetic sequence
ttgcactgcacat

SEQ ID NO: 8593 - DNA, 13 bp, Artificial Sequence
  synthetic sequence
tgttttggcgttc

SEQ ID NO: 8594 - DNA, 13 bp, Artificial Sequence
  synthetic sequence
ctgtcactgtatc

SEQ ID NO: 8595 - DNA, 13 bp, Artificial Sequence
  synthetic sequence
agataatctggcc

SEQ ID NO: 8596 - DNA, 13 bp, Artificial Sequence
  synthetic sequence
tctcagcagcagt

SEQ ID NO: 8597 - DNA, 13 bp, Artificial Sequence
  synthetic sequence
cttggcatctagc

SEQ ID NO: 8598 - DNA, 13 bp, Artificial Sequence
  synthetic sequence
acatattgtccat

SEQ ID NO: 8599 - DNA, 13 bp, Artificial Sequence
  synthetic sequence
tcttgagccaccc

SEQ ID NO: 8600 - DNA, 13 bp, Artificial Sequence
  synthetic sequence
actgggtttctcg

SEQ ID NO: 8601 - DNA, 13 bp, Artificial Sequence
  synthetic sequence
ttcaacattaatg

SEQ ID NO: 8602 - DNA, 13 bp, Artificial Sequence
  synthetic sequence
cactatacccaca

SEQ ID NO: 8603 - DNA, 13 bp, Artificial Sequence
  synthetic sequence
agttgccctgcat

SEQ ID NO: 8604 - DNA, 13 bp, Artificial Sequence
  synthetic sequence
aacagaatcattc

SEQ ID NO: 8605 - DNA, 13 bp, Artificial Sequence
  synthetic sequence
tgagccactctat

SEQ ID NO: 8606 - DNA, 13 bp, Artificial Sequence
  synthetic sequence
tcctttaatttgg

SEQ ID NO: 8607 - DNA, 13 bp, Artificial Sequence
  synthetic sequence
atgcgttgcactg

SEQ ID NO: 8608 - DNA, 13 bp, Artificial Sequence
  synthetic sequence
aacttccaccacc

SEQ ID NO: 8609 - DNA, 13 bp, Artificial Sequence
  synthetic sequence
tcaatggtagcaa

SEQ ID NO: 8610 - DNA, 13 bp, Artificial Sequence
  synthetic sequence
catgttcgcacct

SEQ ID NO: 8611 - DNA, 13 bp, Artificial Sequence
  synthetic sequence
cccacctatcata

SEQ ID NO: 8612 - DNA, 13 bp, Artificial Sequence
  synthetic sequence
tgagtcgacttcc

SEQ ID NO: 8613 - DNA, 13 bp, Artificial Sequence
  synthetic sequence
agaacgcaggtag

SEQ ID NO: 8614 - DNA, 13 bp, Artificial Sequence
  synthetic sequence
aaccacacggggc

SEQ ID NO: 8615 - DNA, 13 bp, Artificial Sequence
  synthetic sequence
ctgtgtactcatc

SEQ ID NO: 8616 - DNA, 13 bp, Artificial Sequence
  synthetic sequence
attattgctctgt

SEQ ID NO: 8617 - DNA, 13 bp, Artificial Sequence
  synthetic sequence
aggttgttagtgc

SEQ ID NO: 8618 - DNA, 13 bp, Artificial Sequence
  synthetic sequence
aacatgtccaagg

SEQ ID NO: 8619 - DNA, 13 bp, Artificial Sequence
  synthetic sequence
tctttgtccacta

SEQ ID NO: 8620 - DNA, 13 bp, Artificial Sequence
  synthetic sequence
gggtcttttgtcc

SEQ ID NO: 8621 - DNA, 13 bp, Artificial Sequence
  synthetic sequence
gcacgtacattat

SEQ ID NO: 8622 - DNA, 13 bp, Artificial Sequence
  synthetic sequence
tccctgggtcttg

SEQ ID NO: 8623 - DNA, 13 bp, Artificial Sequence
  synthetic sequence
acttcttctttag

SEQ ID NO: 8624 - DNA, 13 bp, Artificial Sequence
  synthetic sequence
gcagacctacaca

SEQ ID NO: 8625 - DNA, 13 bp, Artificial Sequence
  synthetic sequence
gcaactgatttcc

SEQ ID NO: 8626 - DNA, 13 bp, Artificial Sequence
  synthetic sequence
ctttgccagcctc

SEQ ID NO: 8627 - DNA, 13 bp, Artificial Sequence
  synthetic sequence
taacatgcttggg

SEQ ID NO: 8628 - DNA, 13 bp, Artificial Sequence
  synthetic sequence
tgcattggcacct

SEQ ID NO: 8629 - DNA, 13 bp, Artificial Sequence
  synthetic sequence
gttgtttaggtta

SEQ ID NO: 8630 - DNA, 13 bp, Artificial Sequence
  synthetic sequence
ttggcacgaatgt

SEQ ID NO: 8631 - DNA, 13 bp, Artificial Sequence
  synthetic sequence
catccttacgact

SEQ ID NO: 8632 - DNA, 13 bp, Artificial Sequence
  synthetic sequence
ttgctgagttgga

SEQ ID NO: 8633 - DNA, 13 bp, Artificial Sequence
  synthetic sequence
ccgtgcaatggct

SEQ ID NO: 8634 - DNA, 13 bp, Artificial Sequence
  synthetic sequence
gtcactccagtca

SEQ ID NO: 8635 - DNA, 13 bp, Artificial Sequence
  synthetic sequence
gatacaaagcaca

SEQ ID NO: 8636 - DNA, 13 bp, Artificial Sequence
  synthetic sequence
tgttgagacttga

SEQ ID NO: 8637 - DNA, 13 bp, Artificial Sequence
  synthetic sequence
atattcctttgtt

SEQ ID NO: 8638 - DNA, 13 bp, Artificial Sequence
  synthetic sequence
caccccatatgcg

SEQ ID NO: 8639 - DNA, 13 bp, Artificial Sequence
  synthetic sequence
cttttggcctcag

SEQ ID NO: 8640 - DNA, 13 bp, Artificial Sequence
  synthetic sequence
tggcagtcactgt

SEQ ID NO: 8641 - DNA, 13 bp, Artificial Sequence
  synthetic sequence
ccaaacacttggc

SEQ ID NO: 8642 - DNA, 13 bp, Artificial Sequence
  synthetic sequence
gtctgaaactgtt

SEQ ID NO: 8643 - DNA, 13 bp, Artificial Sequence
  synthetic sequence
ttcccacgtacgc

SEQ ID NO: 8644 - DNA, 13 bp, Artificial Sequence
  synthetic sequence
attgttcatctgc

SEQ ID NO: 8645 - DNA, 13 bp, Artificial Sequence
  synthetic sequence
ccatccttgtcca

SEQ ID NO: 8646 - DNA, 13 bp, Artificial Sequence
  synthetic sequence
cctgctccattgc

SEQ ID NO: 8647 - DNA, 13 bp, Artificial Sequence
  synthetic sequence
gtaaacatttcta

SEQ ID NO: 8648 - DNA, 13 bp, Artificial Sequence
  synthetic sequence
gcattctctttgt

SEQ ID NO: 8649 - DNA, 13 bp, Artificial Sequence
  synthetic sequence
ggtgaccattccc

SEQ ID NO: 8650 - DNA, 13 bp, Artificial Sequence
  synthetic sequence
ctttgagtcgcgg

SEQ ID NO: 8651 - DNA, 13 bp, Artificial Sequence
  synthetic sequence
caccacgcacaaa

SEQ ID NO: 8652 - DNA, 13 bp, Artificial Sequence
  synthetic sequence
tgtaaccatcaaa

SEQ ID NO: 8653 - DNA, 13 bp, Artificial Sequence
  synthetic sequence
aagatggaatcct

SEQ ID NO: 8654 - DNA, 13 bp, Artificial Sequence
  synthetic sequence
gcgttgagacctg

SEQ ID NO: 8655 - DNA, 13 bp, Artificial Sequence
  synthetic sequence
tccagaacacact

SEQ ID NO: 8656 - DNA, 13 bp, Artificial Sequence
  synthetic sequence
gtgaggatctgag

SEQ ID NO: 8657 - DNA, 13 bp, Artificial Sequence
  synthetic sequence
gctgtgccgcttg

SEQ ID NO: 8658 - DNA, 13 bp, Artificial Sequence
  synthetic sequence
tggaaccaggaca

SEQ ID NO: 8659 - DNA, 13 bp, Artificial Sequence
  synthetic sequence
atcccttctcctt

SEQ ID NO: 8660 - DNA, 13 bp, Artificial Sequence
  synthetic sequence
atcctaatagtac

SEQ ID NO: 8661 - DNA, 13 bp, Artificial Sequence
  synthetic sequence
ccatgtgctgttg

SEQ ID NO: 8662 - DNA, 13 bp, Artificial Sequence
  synthetic sequence
tgccagacccctc

SEQ ID NO: 8663 - DNA, 13 bp, Artificial Sequence
  synthetic sequence
ttagcacagtagg

SEQ ID NO: 8664 - DNA, 13 bp, Artificial Sequence
  synthetic sequence
actccaaaagagg

SEQ ID NO: 8665 - DNA, 13 bp, Artificial Sequence
  synthetic sequence
ttgtctaaagttg

SEQ ID NO: 8666 - DNA, 13 bp, Artificial Sequence
  synthetic sequence
gacacgaagcaca

SEQ ID NO: 8667 - DNA, 13 bp, Artificial Sequence
  synthetic sequence
ctgggccctcaaa

SEQ ID NO: 8668 - DNA, 13 bp, Artificial Sequence
  synthetic sequence
ttcactgtccttt

SEQ ID NO: 8669 - DNA, 13 bp, Artificial Sequence
  synthetic sequence
agtgggtgtagta

SEQ ID NO: 8670 - DNA, 13 bp, Artificial Sequence
  synthetic sequence
cagatcatcgtgg

SEQ ID NO: 8671 - DNA, 13 bp, Artificial Sequence
  synthetic sequence
actctatcactgt

SEQ ID NO: 8672 - DNA, 13 bp, Artificial Sequence
  synthetic sequence
ctaccaattgcgg

SEQ ID NO: 8673 - DNA, 13 bp, Artificial Sequence
  synthetic sequence
tctcctggaacca

SEQ ID NO: 8674 - DNA, 13 bp, Artificial Sequence
  synthetic sequence
gatgcttcaataa

SEQ ID NO: 8675 - DNA, 13 bp, Artificial Sequence
  synthetic sequence
ccatacaccccat

SEQ ID NO: 8676 - DNA, 13 bp, Artificial Sequence
  synthetic sequence
ctagttgttgtca

SEQ ID NO: 8677 - DNA, 13 bp, Artificial Sequence
  synthetic sequence
agaaattggcagc

SEQ ID NO: 8678 - DNA, 13 bp, Artificial Sequence
  synthetic sequence
gtgggcactttgg

SEQ ID NO: 8679 - DNA, 13 bp, Artificial Sequence
  synthetic sequence
agtatctgacttg

SEQ ID NO: 8680 - DNA, 13 bp, Artificial Sequence
  synthetic sequence
tccaacccttcgg

SEQ ID NO: 8681 - DNA, 13 bp, Artificial Sequence
  synthetic sequence
atcttcttctcaa

SEQ ID NO: 8682 - DNA, 13 bp, Artificial Sequence
  synthetic sequence
gcagatctacaca

SEQ ID NO: 8683 - DNA, 13 bp, Artificial Sequence
  synthetic sequence
gtggtccttggaa

SEQ ID NO: 8684 - DNA, 13 bp, Artificial Sequence
  synthetic sequence
ctgtatactggtg

SEQ ID NO: 8685 - DNA, 13 bp, Artificial Sequence
  synthetic sequence
cctcagcaagtaa

SEQ ID NO: 8686 - DNA, 13 bp, Artificial Sequence
  synthetic sequence
atcagtgttctaa

SEQ ID NO: 8687 - DNA, 13 bp, Artificial Sequence
  synthetic sequence
attggtggtacaa

SEQ ID NO: 8688 - DNA, 13 bp, Artificial Sequence
  synthetic sequence
gttggtgcattaa

SEQ ID NO: 8689 - DNA, 13 bp, Artificial Sequence
  synthetic sequence
tgggtatcctgca

SEQ ID NO: 8690 - DNA, 13 bp, Artificial Sequence
  synthetic sequence
agagctctgtgca

SEQ ID NO: 8691 - DNA, 13 bp, Artificial Sequence
  synthetic sequence
acaaatcctacaa

SEQ ID NO: 8692 - DNA, 13 bp, Artificial Sequence
  synthetic sequence
attgcatctaccc

SEQ ID NO: 8693 - DNA, 13 bp, Artificial Sequence
  synthetic sequence
ctcttagcttcag

SEQ ID NO: 8694 - DNA, 13 bp, Artificial Sequence
  synthetic sequence
cctccatcatgta

SEQ ID NO: 8695 - DNA, 13 bp, Artificial Sequence
  synthetic sequence
ctgcactgccagt

SEQ ID NO: 8696 - DNA, 13 bp, Artificial Sequence
  synthetic sequence
tgatctccctgta

SEQ ID NO: 8697 - DNA, 13 bp, Artificial Sequence
  synthetic sequence
acattatctggtg

SEQ ID NO: 8698 - DNA, 13 bp, Artificial Sequence
  synthetic sequence
ttccttcggtcca

SEQ ID NO: 8699 - DNA, 13 bp, Artificial Sequence
  synthetic sequence
tcagcaagcaaag

SEQ ID NO: 8700 - DNA, 13 bp, Artificial Sequence
  synthetic sequence
ggtgtgttgataa

SEQ ID NO: 8701 - DNA, 13 bp, Artificial Sequence
  synthetic sequence
tgacctctggcaa

SEQ ID NO: 8702 - DNA, 13 bp, Artificial Sequence
  synthetic sequence
tagcaattgtgtc

SEQ ID NO: 8703 - DNA, 13 bp, Artificial Sequence
  synthetic sequence
gagtccgggacgt

SEQ ID NO: 8704 - DNA, 13 bp, Artificial Sequence
  synthetic sequence
cacccatacctgc

SEQ ID NO: 8705 - DNA, 13 bp, Artificial Sequence
  synthetic sequence
tctccatcaagtt

SEQ ID NO: 8706 - DNA, 13 bp, Artificial Sequence
  synthetic sequence
aggaggatgctcc

SEQ ID NO: 8707 - DNA, 13 bp, Artificial Sequence
  synthetic sequence
gcttgaaatatat

SEQ ID NO: 8708 - DNA, 13 bp, Artificial Sequence
  synthetic sequence
ttcttggtggtgc

SEQ ID NO: 8709 - DNA, 13 bp, Artificial Sequence
  synthetic sequence
gtttttgggtaca

SEQ ID NO: 8710 - DNA, 13 bp, Artificial Sequence
  synthetic sequence
aaaaaggtgacat

SEQ ID NO: 8711 - DNA, 13 bp, Artificial Sequence
  synthetic sequence
tctatttactacc

SEQ ID NO: 8712 - DNA, 13 bp, Artificial Sequence
  synthetic sequence
atgtatgccctgt

SEQ ID NO: 8713 - DNA, 13 bp, Artificial Sequence
  synthetic sequence
gcgagaaatgtga

SEQ ID NO: 8714 - DNA, 13 bp, Artificial Sequence
  synthetic sequence
ccacaccccgtac

SEQ ID NO: 8715 - DNA, 13 bp, Artificial Sequence
  synthetic sequence
acaatgtaaacac

SEQ ID NO: 8716 - DNA, 13 bp, Artificial Sequence
  synthetic sequence
gtgcgccagtctt

SEQ ID NO: 8717 - DNA, 13 bp, Artificial Sequence
  synthetic sequence
gatcaggttggtt

SEQ ID NO: 8718 - DNA, 13 bp, Artificial Sequence
  synthetic sequence
gtgcactttgctc

SEQ ID NO: 8719 - DNA, 13 bp, Artificial Sequence
  synthetic sequence
tctctaggacgga

SEQ ID NO: 8720 - DNA, 13 bp, Artificial Sequence
  synthetic sequence
ccagcttcctacg

SEQ ID NO: 8721 - DNA, 13 bp, Artificial Sequence
  synthetic sequence
cgccagtttccgt

SEQ ID NO: 8722 - DNA, 13 bp, Artificial Sequence
  synthetic sequence
gctgtggtggtac

SEQ ID NO: 8723 - DNA, 13 bp, Artificial Sequence
  synthetic sequence
atccatgatcacc

SEQ ID NO: 8724 - DNA, 13 bp, Artificial Sequence
  synthetic sequence
ttcacaccctgtt

SEQ ID NO: 8725 - DNA, 13 bp, Artificial Sequence
  synthetic sequence
tgctcgcatctaa

SEQ ID NO: 8726 - DNA, 13 bp, Artificial Sequence
  synthetic sequence
aatttcttaagcc

SEQ ID NO: 8727 - DNA, 13 bp, Artificial Sequence
  synthetic sequence
ctcaccgcttcgc

SEQ ID NO: 8728 - DNA, 13 bp, Artificial Sequence
  synthetic sequence
tagattacacaag

SEQ ID NO: 8729 - DNA, 13 bp, Artificial Sequence
  synthetic sequence
taaccggacctac

SEQ ID NO: 8730 - DNA, 13 bp, Artificial Sequence
  synthetic sequence
actgttggcgcgt

SEQ ID NO: 8731 - DNA, 13 bp, Artificial Sequence
  synthetic sequence
taagtgaacattt

SEQ ID NO: 8732 - DNA, 13 bp, Artificial Sequence
  synthetic sequence
gtaaccaacaaat

SEQ ID NO: 8733 - DNA, 13 bp, Artificial Sequence
  synthetic sequence
gaggttaagaatt

SEQ ID NO: 8734 - DNA, 13 bp, Artificial Sequence
  synthetic sequence
agagcaagagtgg

SEQ ID NO: 8735 - DNA, 13 bp, Artificial Sequence
  synthetic sequence
cttcctgctatct

SEQ ID NO: 8736 - DNA, 13 bp, Artificial Sequence
  synthetic sequence
tcactgaggtagt

SEQ ID NO: 8737 - DNA, 13 bp, Artificial Sequence
  synthetic sequence
catcagttgacct

SEQ ID NO: 8738 - DNA, 13 bp, Artificial Sequence
  synthetic sequence
atttatcttttcg

SEQ ID NO: 8739 - DNA, 13 bp, Artificial Sequence
  synthetic sequence
acggttacagtaa

SEQ ID NO: 8740 - DNA, 13 bp, Artificial Sequence
  synthetic sequence
ctccatttctgag

SEQ ID NO: 8741 - DNA, 13 bp, Artificial Sequence
  synthetic sequence
tattgactagcct

SEQ ID NO: 8742 - DNA, 13 bp, Artificial Sequence
  synthetic sequence
tgtgtaataattc

SEQ ID NO: 8743 - DNA, 13 bp, Artificial Sequence
  synthetic sequence
ccgcctgttgcac

SEQ ID NO: 8744 - DNA, 13 bp, Artificial Sequence
  synthetic sequence
cttaaccgacatg

SEQ ID NO: 8745 - DNA, 13 bp, Artificial Sequence
  synthetic sequence
ctccatgaggttt

SEQ ID NO: 8746 - DNA, 13 bp, Artificial Sequence
  synthetic sequence
actacagcgcggt

SEQ ID NO: 8747 - DNA, 13 bp, Artificial Sequence
  synthetic sequence
tggccaagtgtct

SEQ ID NO: 8748 - DNA, 13 bp, Artificial Sequence
  synthetic sequence
aggccctgctgtc

SEQ ID NO: 8749 - DNA, 13 bp, Artificial Sequence
  synthetic sequence
gaaatttccacca

SEQ ID NO: 8750 - DNA, 13 bp, Artificial Sequence
  synthetic sequence
gctcgctctgctg

SEQ ID NO: 8751 - DNA, 13 bp, Artificial Sequence
  synthetic sequence
taccctgatctac

SEQ ID NO: 8752 - DNA, 13 bp, Artificial Sequence
  synthetic sequence
taactatccttgg

SEQ ID NO: 8753 - DNA, 13 bp, Artificial Sequence
  synthetic sequence
gcagccattggtg

SEQ ID NO: 8754 - DNA, 13 bp, Artificial Sequence
  synthetic sequence
atggtgcgctttg

SEQ ID NO: 8755 - DNA, 13 bp, Artificial Sequence
  synthetic sequence
tttgtcatctaca

SEQ ID NO: 8756 - DNA, 13 bp, Artificial Sequence
  synthetic sequence
gtgcattttctgc

SEQ ID NO: 8757 - DNA, 13 bp, Artificial Sequence
  synthetic sequence
cgcacgaagtagt

SEQ ID NO: 8758 - DNA, 13 bp, Artificial Sequence
  synthetic sequence
ttcttcacctcac

SEQ ID NO: 8759 - DNA, 13 bp, Artificial Sequence
  synthetic sequence
agcttccaccacc

SEQ ID NO: 8760 - DNA, 13 bp, Artificial Sequence
  synthetic sequence
acaaggatcgcac

SEQ ID NO: 8761 - DNA, 13 bp, Artificial Sequence
  synthetic sequence
ctctttctacagc

SEQ ID NO: 8762 - DNA, 13 bp, Artificial Sequence
  synthetic sequence
ggtccacttgaga

SEQ ID NO: 8763 - DNA, 13 bp, Artificial Sequence
  synthetic sequence
ttgccgaattgga

SEQ ID NO: 8764 - DNA, 13 bp, Artificial Sequence
  synthetic sequence
caaaccatacggg

SEQ ID NO: 8765 - DNA, 13 bp, Artificial Sequence
  synthetic sequence
ttgtaaactcacc

SEQ ID NO: 8766 - DNA, 13 bp, Artificial Sequence
  synthetic sequence
caccaacatgtat

SEQ ID NO: 8767 - DNA, 13 bp, Artificial Sequence
  synthetic sequence
ggccatatttgtc

SEQ ID NO: 8768 - DNA, 13 bp, Artificial Sequence
  synthetic sequence
cagtgttctgatg

SEQ ID NO: 8769 - DNA, 13 bp, Artificial Sequence
  synthetic sequence
ggaaccgactact

SEQ ID NO: 8770 - DNA, 13 bp, Artificial Sequence
  synthetic sequence
tcctagcccaatc

SEQ ID NO: 8771 - DNA, 13 bp, Artificial Sequence
  synthetic sequence
ggtgtgaagagcc

SEQ ID NO: 8772 - DNA, 13 bp, Artificial Sequence
  synthetic sequence
ttggattggccat

SEQ ID NO: 8773 - DNA, 13 bp, Artificial Sequence
  synthetic sequence
gatgagtctggac

SEQ ID NO: 8774 - DNA, 13 bp, Artificial Sequence
  synthetic sequence
aacctacaagggc

SEQ ID NO: 8775 - DNA, 13 bp, Artificial Sequence
  synthetic sequence
accaaaacaaagc

SEQ ID NO: 8776 - DNA, 13 bp, Artificial Sequence
  synthetic sequence
aatgatcacaacc

SEQ ID NO: 8777 - DNA, 13 bp, Artificial Sequence
  synthetic sequence
ccaagttcaatag

SEQ ID NO: 8778 - DNA, 13 bp, Artificial Sequence
  synthetic sequence
tgatggaattggc

SEQ ID NO: 8779 - DNA, 13 bp, Artificial Sequence
  synthetic sequence
cagacattagaga

SEQ ID NO: 8780 - DNA, 13 bp, Artificial Sequence
  synthetic sequence
tcacatgggagaa

SEQ ID NO: 8781 - DNA, 13 bp, Artificial Sequence
  synthetic sequence
ggatgcatgttgg

SEQ ID NO: 8782 - DNA, 13 bp, Artificial Sequence
  synthetic sequence
tccaagttcaccg

SEQ ID NO: 8783 - DNA, 13 bp, Artificial Sequence
  synthetic sequence
agagacctcttag

SEQ ID NO: 8784 - DNA, 13 bp, Artificial Sequence
  synthetic sequence
gtggtggcatact

SEQ ID NO: 8785 - DNA, 13 bp, Artificial Sequence
  synthetic sequence
aattatgaggaca

SEQ ID NO: 8786 - DNA, 13 bp, Artificial Sequence
  synthetic sequence
atgaaagaggcag

SEQ ID NO: 8787 - DNA, 13 bp, Artificial Sequence
  synthetic sequence
gttttgtgtcagc

SEQ ID NO: 8788 - DNA, 13 bp, Artificial Sequence
  synthetic sequence
cagtggatgagac

SEQ ID NO: 8789 - DNA, 13 bp, Artificial Sequence
  synthetic sequence
cagtatgtttgtt

SEQ ID NO: 8790 - DNA, 13 bp, Artificial Sequence
  synthetic sequence
atcaattagatgg

SEQ ID NO: 8791 - DNA, 13 bp, Artificial Sequence
  synthetic sequence
aaggaaccagcag

SEQ ID NO: 8792 - DNA, 13 bp, Artificial Sequence
  synthetic sequence
catgtgacatcct

SEQ ID NO: 8793 - DNA, 13 bp, Artificial Sequence
  synthetic sequence
accatcaattaca

SEQ ID NO: 8794 - DNA, 13 bp, Artificial Sequence
  synthetic sequence
acaacaactgggg

SEQ ID NO: 8795 - DNA, 13 bp, Artificial Sequence
  synthetic sequence
tagctaaaatcag

SEQ ID NO: 8796 - DNA, 13 bp, Artificial Sequence
  synthetic sequence
tgagagattactg

SEQ ID NO: 8797 - DNA, 13 bp, Artificial Sequence
  synthetic sequence
tggctactgaaat

SEQ ID NO: 8798 - DNA, 13 bp, Artificial Sequence
  synthetic sequence
gtggctcacagtg

SEQ ID NO: 8799 - DNA, 13 bp, Artificial Sequence
  synthetic sequence
tttctttcattgg

SEQ ID NO: 8800 - DNA, 13 bp, Artificial Sequence
  synthetic sequence
atggtaactagca

SEQ ID NO: 8801 - DNA, 13 bp, Artificial Sequence
  synthetic sequence
catacagacaaac

SEQ ID NO: 8802 - DNA, 13 bp, Artificial Sequence
  synthetic sequence
ccaggtgttgatt

SEQ ID NO: 8803 - DNA, 13 bp, Artificial Sequence
  synthetic sequence
taaaagacatggg

SEQ ID NO: 8804 - DNA, 13 bp, Artificial Sequence
  synthetic sequence
gcgtgcaggttct

SEQ ID NO: 8805 - DNA, 13 bp, Artificial Sequence
  synthetic sequence
ggtccttgaaatt

SEQ ID NO: 8806 - DNA, 13 bp, Artificial Sequence
  synthetic sequence
caatgcttgggac

SEQ ID NO: 8807 - DNA, 13 bp, Artificial Sequence
  synthetic sequence
aagtttcatcaag

SEQ ID NO: 8808 - DNA, 13 bp, Artificial Sequence
  synthetic sequence
tcgggagtggagt

SEQ ID NO: 8809 - DNA, 13 bp, Artificial Sequence
  synthetic sequence
aaatcactgagac

SEQ ID NO: 8810 - DNA, 13 bp, Artificial Sequence
  synthetic sequence
tgaccattgctcc

SEQ ID NO: 8811 - DNA, 13 bp, Artificial Sequence
  synthetic sequence
tttggaaaataac

SEQ ID NO: 8812 - DNA, 13 bp, Artificial Sequence
  synthetic sequence
ttgagtcattctt

SEQ ID NO: 8813 - DNA, 13 bp, Artificial Sequence
  synthetic sequence
cttgtgtctctcg

SEQ ID NO: 8814 - DNA, 13 bp, Artificial Sequence
  synthetic sequence
tggagacaggggc

SEQ ID NO: 8815 - DNA, 13 bp, Artificial Sequence
  synthetic sequence
ttcagttaatgga

SEQ ID NO: 8816 - DNA, 13 bp, Artificial Sequence
  synthetic sequence
agtaaccagtacc

SEQ ID NO: 8817 - DNA, 13 bp, Artificial Sequence
  synthetic sequence
ctaaaaatgcatt

SEQ ID NO: 8818 - DNA, 13 bp, Artificial Sequence
  synthetic sequence
tctcactttgatg

SEQ ID NO: 8819 - DNA, 13 bp, Artificial Sequence
  synthetic sequence
tatccaaattcat

SEQ ID NO: 8820 - DNA, 13 bp, Artificial Sequence
  synthetic sequence
acgtggcagacgt

SEQ ID NO: 8821 - DNA, 13 bp, Artificial Sequence
  synthetic sequence
aatccaggcgaaa

SEQ ID NO: 8822 - DNA, 13 bp, Artificial Sequence
  synthetic sequence
gatgggtttgcaa

SEQ ID NO: 8823 - DNA, 13 bp, Artificial Sequence
  synthetic sequence
atcaccacccaag

SEQ ID NO: 8824 - DNA, 13 bp, Artificial Sequence
  synthetic sequence
catgcattgaacc

SEQ ID NO: 8825 - DNA, 13 bp, Artificial Sequence
  synthetic sequence
acaaaaacccagg

SEQ ID NO: 8826 - DNA, 13 bp, Artificial Sequence
  synthetic sequence
atccgttacccgc

SEQ ID NO: 8827 - DNA, 13 bp, Artificial Sequence
  synthetic sequence
aattgcatggaag

SEQ ID NO: 8828 - DNA, 13 bp, Artificial Sequence
  synthetic sequence
ttttgtcaaatgg

SEQ ID NO: 8829 - DNA, 13 bp, Artificial Sequence
  synthetic sequence
cttgtccaagtca

SEQ ID NO: 8830 - DNA, 13 bp, Artificial Sequence
  synthetic sequence
gtgctgtgactga

SEQ ID NO: 8831 - DNA, 13 bp, Artificial Sequence
  synthetic sequence
aaaacatactgtg

SEQ ID NO: 8832 - DNA, 13 bp, Artificial Sequence
  synthetic sequence
agaggtttgcacc

SEQ ID NO: 8833 - DNA, 13 bp, Artificial Sequence
  synthetic sequence
ccaattaatcaaa

SEQ ID NO: 8834 - DNA, 13 bp, Artificial Sequence
  synthetic sequence
gtgctgtgaccga

SEQ ID NO: 8835 - DNA, 13 bp, Artificial Sequence
  synthetic sequence
acagggtatgatg

SEQ ID NO: 8836 - DNA, 13 bp, Artificial Sequence
  synthetic sequence
tgattgacaacac

SEQ ID NO: 8837 - DNA, 13 bp, Artificial Sequence
  synthetic sequence
aaaccagagacac

SEQ ID NO: 8838 - DNA, 13 bp, Artificial Sequence
  synthetic sequence
gttacagcaacta

SEQ ID NO: 8839 - DNA, 13 bp, Artificial Sequence
  synthetic sequence
tccagtcaccgtg

SEQ ID NO: 8840 - DNA, 13 bp, Artificial Sequence
  synthetic sequence
catgtgatctggg

SEQ ID NO: 8841 - DNA, 13 bp, Artificial Sequence
  synthetic sequence
ctagagacaccaa

SEQ ID NO: 8842 - DNA, 13 bp, Artificial Sequence
  synthetic sequence
acactgggaaact

SEQ ID NO: 8843 - DNA, 13 bp, Artificial Sequence
  synthetic sequence
gggacatgggact

SEQ ID NO: 8844 - DNA, 13 bp, Artificial Sequence
  synthetic sequence
actccaaggaaat

SEQ ID NO: 8845 - DNA, 13 bp, Artificial Sequence
  synthetic sequence
catcaaatccatc

SEQ ID NO: 8846 - DNA, 13 bp, Artificial Sequence
  synthetic sequence
actgggcaggatc

SEQ ID NO: 8847 - DNA, 13 bp, Artificial Sequence
  synthetic sequence
ttatgtacttcga

SEQ ID NO: 8848 - DNA, 13 bp, Artificial Sequence
  synthetic sequence
cagtgtggaagat

SEQ ID NO: 8849 - DNA, 13 bp, Artificial Sequence
  synthetic sequence
tactctgcctgtc

SEQ ID NO: 8850 - DNA, 13 bp, Artificial Sequence
  synthetic sequence
ggtcagagtctag

SEQ ID NO: 8851 - DNA, 13 bp, Artificial Sequence
  synthetic sequence
cgtaccagagatg

SEQ ID NO: 8852 - DNA, 13 bp, Artificial Sequence
  synthetic sequence
caaaccatagatg

SEQ ID NO: 8853 - DNA, 13 bp, Artificial Sequence
  synthetic sequence
gccaatcctggcg

SEQ ID NO: 8854 - DNA, 13 bp, Artificial Sequence
  synthetic sequence
ttttccaaagtac

SEQ ID NO: 8855 - DNA, 13 bp, Artificial Sequence
  synthetic sequence
gtgacaaccttcg

SEQ ID NO: 8856 - DNA, 13 bp, Artificial Sequence
  synthetic sequence
aacaatgggcatg

SEQ ID NO: 8857 - DNA, 13 bp, Artificial Sequence
  synthetic sequence
ttggaaatggcac

SEQ ID NO: 8858 - DNA, 13 bp, Artificial Sequence
  synthetic sequence
tcctacaagcagt

SEQ ID NO: 8859 - DNA, 13 bp, Artificial Sequence
  synthetic sequence
gtcgctgcatgca

SEQ ID NO: 8860 - DNA, 13 bp, Artificial Sequence
  synthetic sequence
acaataattgggg

SEQ ID NO: 8861 - DNA, 13 bp, Artificial Sequence
  synthetic sequence
gtgcccaccatta

SEQ ID NO: 8862 - DNA, 13 bp, Artificial Sequence
  synthetic sequence
tgtacaaaaacaa

SEQ ID NO: 8863 - DNA, 13 bp, Artificial Sequence
  synthetic sequence
acaaacaacaggg

SEQ ID NO: 8864 - DNA, 13 bp, Artificial Sequence
  synthetic sequence
agggaaaatccag

SEQ ID NO: 8865 - DNA, 13 bp, Artificial Sequence
  synthetic sequence
tggatgccaaagc

SEQ ID NO: 8866 - DNA, 13 bp, Artificial Sequence
  synthetic sequence
gccctagtcagga

SEQ ID NO: 8867 - DNA, 13 bp, Artificial Sequence
  synthetic sequence
tggtttgaggcac

SEQ ID NO: 8868 - DNA, 13 bp, Artificial Sequence
  synthetic sequence
aatactacccagt

SEQ ID NO: 8869 - DNA, 13 bp, Artificial Sequence
  synthetic sequence
atgccatgtatgg

SEQ ID NO: 8870 - DNA, 13 bp, Artificial Sequence
  synthetic sequence
taatggacaaatc

SEQ ID NO: 8871 - DNA, 13 bp, Artificial Sequence
  synthetic sequence
ccatgtacggcac

SEQ ID NO: 8872 - DNA, 13 bp, Artificial Sequence
  synthetic sequence
ccaccattaatta

SEQ ID NO: 8873 - DNA, 13 bp, Artificial Sequence
  synthetic sequence
tgaccatagcccc

SEQ ID NO: 8874 - DNA, 13 bp, Artificial Sequence
  synthetic sequence
tttcaacagttat

SEQ ID NO: 8875 - DNA, 13 bp, Artificial Sequence
  synthetic sequence
ttcagagatatca

SEQ ID NO: 8876 - DNA, 13 bp, Artificial Sequence
  synthetic sequence
ttacagcaaccac

SEQ ID NO: 8877 - DNA, 13 bp, Artificial Sequence
  synthetic sequence
tagctaaaattag

SEQ ID NO: 8878 - DNA, 13 bp, Artificial Sequence
  synthetic sequence
aacgacccaatgt

SEQ ID NO: 8879 - DNA, 13 bp, Artificial Sequence
  synthetic sequence
caatcagatggac

SEQ ID NO: 8880 - DNA, 13 bp, Artificial Sequence
  synthetic sequence
aggggaaatccag

SEQ ID NO: 8881 - DNA, 13 bp, Artificial Sequence
  synthetic sequence
attcaatggatga

SEQ ID NO: 8882 - DNA, 13 bp, Artificial Sequence
  synthetic sequence
attgtatggaggc

SEQ ID NO: 8883 - DNA, 13 bp, Artificial Sequence
  synthetic sequence
aaggagaaaatta

SEQ ID NO: 8884 - DNA, 13 bp, Artificial Sequence
  synthetic sequence
gtggaaattcttg

SEQ ID NO: 8885 - DNA, 13 bp, Artificial Sequence
  synthetic sequence
gtggcacacagtg

SEQ ID NO: 8886 - DNA, 13 bp, Artificial Sequence
  synthetic sequence
tctgccaaatggt

SEQ ID NO: 8887 - DNA, 13 bp, Artificial Sequence
  synthetic sequence
gtgaaaagaaagg

SEQ ID NO: 8888 - DNA, 13 bp, Artificial Sequence
  synthetic sequence
aaagaatacagaa

SEQ ID NO: 8889 - DNA, 13 bp, Artificial Sequence
  synthetic sequence
cagatggtatcaa

SEQ ID NO: 8890 - DNA, 13 bp, Artificial Sequence
  synthetic sequence
ccagtatgtttgc

SEQ ID NO: 8891 - DNA, 13 bp, Artificial Sequence
  synthetic sequence
gagatgtgcaaaa

SEQ ID NO: 8892 - DNA, 13 bp, Artificial Sequence
  synthetic sequence
aaagaaccagcag

SEQ ID NO: 8893 - DNA, 13 bp, Artificial Sequence
  synthetic sequence
tcacaatgcttgg

SEQ ID NO: 8894 - DNA, 13 bp, Artificial Sequence
  synthetic sequence
acgccatgtatgg

SEQ ID NO: 8895 - DNA, 13 bp, Artificial Sequence
  synthetic sequence
tatgaagacacca

SEQ ID NO: 8896 - DNA, 13 bp, Artificial Sequence
  synthetic sequence
actggtagtgcag

SEQ ID NO: 8897 - DNA, 13 bp, Artificial Sequence
  synthetic sequence
agaacagcaaaag

SEQ ID NO: 8898 - DNA, 13 bp, Artificial Sequence
  synthetic sequence
aaataacagagtt

SEQ ID NO: 8899 - DNA, 13 bp, Artificial Sequence
  synthetic sequence
gtaacattcttga

SEQ ID NO: 8900 - DNA, 13 bp, Artificial Sequence
  synthetic sequence
atccgttatccgc

SEQ ID NO: 8901 - DNA, 13 bp, Artificial Sequence
  synthetic sequence
gatgagtacatga

SEQ ID NO: 8902 - DNA, 13 bp, Artificial Sequence
  synthetic sequence
taattgaagcctc

SEQ ID NO: 8903 - DNA, 13 bp, Artificial Sequence
  synthetic sequence
ttggtttcgtgtc

SEQ ID NO: 8904 - DNA, 13 bp, Artificial Sequence
  synthetic sequence
ctggagatacctt

SEQ ID NO: 8905 - DNA, 13 bp, Artificial Sequence
  synthetic sequence
atgcaatgtatgg

SEQ ID NO: 8906 - DNA, 13 bp, Artificial Sequence
  synthetic sequence
ctgttggttgtga

SEQ ID NO: 8907 - DNA, 13 bp, Artificial Sequence
  synthetic sequence
tgtatgcacttga

SEQ ID NO: 8908 - DNA, 13 bp, Artificial Sequence
  synthetic sequence
ccttagaagacca

SEQ ID NO: 8909 - DNA, 13 bp, Artificial Sequence
  synthetic sequence
aacacccaggatc

SEQ ID NO: 8910 - DNA, 13 bp, Artificial Sequence
  synthetic sequence
ggcaactgcatgg

SEQ ID NO: 8911 - DNA, 13 bp, Artificial Sequence
  synthetic sequence
tcatcgggatgca

SEQ ID NO: 8912 - DNA, 13 bp, Artificial Sequence
  synthetic sequence
gagcaatgaccat

SEQ ID NO: 8913 - DNA, 13 bp, Artificial Sequence
  synthetic sequence
ccagcttggtttg

SEQ ID NO: 8914 - DNA, 13 bp, Artificial Sequence
  synthetic sequence
gattgattgaagc

SEQ ID NO: 8915 - DNA, 13 bp, Artificial Sequence
  synthetic sequence
tcagtgtgcgctt

SEQ ID NO: 8916 - DNA, 13 bp, Artificial Sequence
  synthetic sequence
gatgaatacatga

SEQ ID NO: 8917 - DNA, 13 bp, Artificial Sequence
  synthetic sequence
tgagttcaatgga

SEQ ID NO: 8918 - DNA, 13 bp, Artificial Sequence
  synthetic sequence
gtcaaggtgaaat

SEQ ID NO: 8919 - DNA, 13 bp, Artificial Sequence
  synthetic sequence
taaccagcatggt

SEQ ID NO: 8920 - DNA, 13 bp, Artificial Sequence
  synthetic sequence
ccaggagattgtg

SEQ ID NO: 8921 - DNA, 13 bp, Artificial Sequence
  synthetic sequence
agttcagagacat

SEQ ID NO: 8922 - DNA, 13 bp, Artificial Sequence
  synthetic sequence
tgtggaacagaga

SEQ ID NO: 8923 - DNA, 13 bp, Artificial Sequence
  synthetic sequence
ttgatggcaaaga

SEQ ID NO: 8924 - DNA, 13 bp, Artificial Sequence
  synthetic sequence
actgtgagaagaa

SEQ ID NO: 8925 - DNA, 13 bp, Artificial Sequence
  synthetic sequence
gaagcgtgccaat

SEQ ID NO: 8926 - DNA, 13 bp, Artificial Sequence
  synthetic sequence
acatgatggaact

SEQ ID NO: 8927 - DNA, 13 bp, Artificial Sequence
  synthetic sequence
gaaatgtgtaaga

SEQ ID NO: 8928 - DNA, 13 bp, Artificial Sequence
  synthetic sequence
accaaagaaatgc

SEQ ID NO: 8929 - DNA, 13 bp, Artificial Sequence
  synthetic sequence
gcagacaattacc

SEQ ID NO: 8930 - DNA, 13 bp, Artificial Sequence
  synthetic sequence
atcacaccaccca

SEQ ID NO: 8931 - DNA, 13 bp, Artificial Sequence
  synthetic sequence
gggtacaaaccag

SEQ ID NO: 8932 - DNA, 13 bp, Artificial Sequence
  synthetic sequence
atggtcaccagca

SEQ ID NO: 8933 - DNA, 13 bp, Artificial Sequence
  synthetic sequence
aacccattaagga

SEQ ID NO: 8934 - DNA, 13 bp, Artificial Sequence
  synthetic sequence
accagtatgtcta

SEQ ID NO: 8935 - DNA, 13 bp, Artificial Sequence
  synthetic sequence
accaaggaaatgc

SEQ ID NO: 8936 - DNA, 13 bp, Artificial Sequence
  synthetic sequence
attgggcaggatc

SEQ ID NO: 8937 - DNA, 13 bp, Artificial Sequence
  synthetic sequence
aactgtatggaag

SEQ ID NO: 8938 - DNA, 13 bp, Artificial Sequence
  synthetic sequence
tcgttggcccaac

SEQ ID NO: 8939 - DNA, 13 bp, Artificial Sequence
  synthetic sequence
gagtgtagcttag

SEQ ID NO: 8940 - DNA, 13 bp, Artificial Sequence
  synthetic sequence
attcagttgatgg

SEQ ID NO: 8941 - DNA, 13 bp, Artificial Sequence
  synthetic sequence
atgtgatttggga

SEQ ID NO: 8942 - DNA, 13 bp, Artificial Sequence
  synthetic sequence
ggaaaatcacgta

SEQ ID NO: 8943 - DNA, 13 bp, Artificial Sequence
  synthetic sequence
cccaacaagaaac

SEQ ID NO: 8944 - DNA, 13 bp, Artificial Sequence
  synthetic sequence
aggaagtggaagt

SEQ ID NO: 8945 - DNA, 13 bp, Artificial Sequence
  synthetic sequence
atgcaatgtacgg

SEQ ID NO: 8946 - DNA, 13 bp, Artificial Sequence
  synthetic sequence
caggttatgatgc

SEQ ID NO: 8947 - DNA, 13 bp, Artificial Sequence
  synthetic sequence
cgatcagagtcca

SEQ ID NO: 8948 - DNA, 13 bp, Artificial Sequence
  synthetic sequence
gtgagaaaaaggg

SEQ ID NO: 8949 - DNA, 13 bp, Artificial Sequence
  synthetic sequence
acttttacgacgg

SEQ ID NO: 8950 - DNA, 13 bp, Artificial Sequence
  synthetic sequence
atcaccactcaag

SEQ ID NO: 8951 - DNA, 13 bp, Artificial Sequence
  synthetic sequence
tagtgcatggcag

SEQ ID NO: 8952 - DNA, 13 bp, Artificial Sequence
  synthetic sequence
acttctatgacgg

SEQ ID NO: 8953 - DNA, 13 bp, Artificial Sequence
  synthetic sequence
taacaggttcagc

SEQ ID NO: 8954 - DNA, 13 bp, Artificial Sequence
  synthetic sequence
acatggcaatggc

SEQ ID NO: 8955 - DNA, 13 bp, Artificial Sequence
  synthetic sequence
ccacaatacacca

SEQ ID NO: 8956 - DNA, 13 bp, Artificial Sequence
  synthetic sequence
ctaccattaatta

SEQ ID NO: 8957 - DNA, 13 bp, Artificial Sequence
  synthetic sequence
aacatggcgatgg

SEQ ID NO: 8958 - DNA, 13 bp, Artificial Sequence
  synthetic sequence
tacaagcaacagg

SEQ ID NO: 8959 - DNA, 13 bp, Artificial Sequence
  synthetic sequence
aacaaaatctcaa

SEQ ID NO: 8960 - DNA, 13 bp, Artificial Sequence
  synthetic sequence
atagacaccatga

SEQ ID NO: 8961 - DNA, 13 bp, Artificial Sequence
  synthetic sequence
tggtcacctcaaa

SEQ ID NO: 8962 - DNA, 13 bp, Artificial Sequence
  synthetic sequence
caatattttacac

SEQ ID NO: 8963 - DNA, 13 bp, Artificial Sequence
  synthetic sequence
aaagaacccgcag

SEQ ID NO: 8964 - DNA, 13 bp, Artificial Sequence
  synthetic sequence
gtcagatggtttc

SEQ ID NO: 8965 - DNA, 13 bp, Artificial Sequence
  synthetic sequence
agtttagagacat

SEQ ID NO: 8966 - DNA, 13 bp, Artificial Sequence
  synthetic sequence
gacatgggattgt

SEQ ID NO: 8967 - DNA, 13 bp, Artificial Sequence
  synthetic sequence
tctaagtacaatt

SEQ ID NO: 8968 - DNA, 13 bp, Artificial Sequence
  synthetic sequence
tcccgtatgttat

SEQ ID NO: 8969 - DNA, 13 bp, Artificial Sequence
  synthetic sequence
aatccaggtgaaa

SEQ ID NO: 8970 - DNA, 13 bp, Artificial Sequence
  synthetic sequence
tctgtcaaatggt

SEQ ID NO: 8971 - DNA, 13 bp, Artificial Sequence
  synthetic sequence
attgtgagaagaa

SEQ ID NO: 8972 - DNA, 13 bp, Artificial Sequence
  synthetic sequence
acggaaaccaaca

SEQ ID NO: 8973 - DNA, 13 bp, Artificial Sequence
  synthetic sequence
gcagttaccactt

SEQ ID NO: 8974 - DNA, 13 bp, Artificial Sequence
  synthetic sequence
ggttgtgacccag

SEQ ID NO: 8975 - DNA, 13 bp, Artificial Sequence
  synthetic sequence
gagacttgtatgc

SEQ ID NO: 8976 - DNA, 13 bp, Artificial Sequence
  synthetic sequence
ttgatggaaagga

SEQ ID NO: 8977 - DNA, 13 bp, Artificial Sequence
  synthetic sequence
ggtgtgtttgctg

SEQ ID NO: 8978 - DNA, 13 bp, Artificial Sequence
  synthetic sequence
tggtaactgcatg

SEQ ID NO: 8979 - DNA, 13 bp, Artificial Sequence
  synthetic sequence
tcaactacaccac

SEQ ID NO: 8980 - DNA, 13 bp, Artificial Sequence
  synthetic sequence
tggtttgaggctc

SEQ ID NO: 8981 - DNA, 13 bp, Artificial Sequence
  synthetic sequence
atatggcaatggc

SEQ ID NO: 8982 - DNA, 13 bp, Artificial Sequence
  synthetic sequence
cttccaacccgtc

SEQ ID NO: 8983 - DNA, 13 bp, Artificial Sequence
  synthetic sequence
actgaagtggatg

SEQ ID NO: 8984 - DNA, 13 bp, Artificial Sequence
  synthetic sequence
atgaccacaaccc

SEQ ID NO: 8985 - DNA, 13 bp, Artificial Sequence
  synthetic sequence
attgtatggaagc

SEQ ID NO: 8986 - DNA, 13 bp, Artificial Sequence
  synthetic sequence
attgattggctaa

SEQ ID NO: 8987 - DNA, 13 bp, Artificial Sequence
  synthetic sequence
ctatggagcaggg

SEQ ID NO: 8988 - DNA, 13 bp, Artificial Sequence
  synthetic sequence
tacaaacaacaag

SEQ ID NO: 8989 - DNA, 13 bp, Artificial Sequence
  synthetic sequence
cttgaaagcatga

SEQ ID NO: 8990 - DNA, 13 bp, Artificial Sequence
  synthetic sequence
acaataactgggg

SEQ ID NO: 8991 - DNA, 13 bp, Artificial Sequence
  synthetic sequence
aaggggagttcac

SEQ ID NO: 8992 - DNA, 13 bp, Artificial Sequence
  synthetic sequence
ggtgagaaggggg

SEQ ID NO: 8993 - DNA, 13 bp, Artificial Sequence
  synthetic sequence
gactgattgaagc

SEQ ID NO: 8994 - DNA, 13 bp, Artificial Sequence
  synthetic sequence
gtggaccaaccaa

SEQ ID NO: 8995 - DNA, 13 bp, Artificial Sequence
  synthetic sequence
gttacaaaatttg

SEQ ID NO: 8996 - DNA, 13 bp, Artificial Sequence
  synthetic sequence
ccaactccagtcg

SEQ ID NO: 8997 - DNA, 13 bp, Artificial Sequence
  synthetic sequence
tataaacaacagg

SEQ ID NO: 8998 - DNA, 13 bp, Artificial Sequence
  synthetic sequence
gtttcactgaggg

SEQ ID NO: 8999 - DNA, 13 bp, Artificial Sequence
  synthetic sequence
gggtttgtgtcag

SEQ ID NO: 9000 - DNA, 13 bp, Artificial Sequence
  synthetic sequence
gtgacattctgga

SEQ ID NO: 9001 - DNA, 13 bp, Artificial Sequence
  synthetic sequence
agacatactgtgt

SEQ ID NO: 9002 - DNA, 13 bp, Artificial Sequence
  synthetic sequence
ataagaacccagg

SEQ ID NO: 9003 - DNA, 13 bp, Artificial Sequence
  synthetic sequence
aaacaacaatact

SEQ ID NO: 9004 - DNA, 13 bp, Artificial Sequence
  synthetic sequence
tccctgcgctcac

SEQ ID NO: 9005 - DNA, 13 bp, Artificial Sequence
  synthetic sequence
agggtggttaatg

SEQ ID NO: 9006 - DNA, 13 bp, Artificial Sequence
  synthetic sequence
caaattgcaacca

SEQ ID NO: 9007 - DNA, 13 bp, Artificial Sequence
  synthetic sequence
atagctccaatgt

SEQ ID NO: 9008 - DNA, 13 bp, Artificial Sequence
  synthetic sequence
ccaggagactgtg

SEQ ID NO: 9009 - DNA, 13 bp, Artificial Sequence
  synthetic sequence
ccaacgtgcccac

SEQ ID NO: 9010 - DNA, 13 bp, Artificial Sequence
  synthetic sequence
gtggcacatagtg

SEQ ID NO: 9011 - DNA, 13 bp, Artificial Sequence
  synthetic sequence
ttccaatacatgg

SEQ ID NO: 9012 - DNA, 13 bp, Artificial Sequence
  synthetic sequence
gacctacaagggc

SEQ ID NO: 9013 - DNA, 13 bp, Artificial Sequence
  synthetic sequence
tacgcacttgagg

SEQ ID NO: 9014 - DNA, 13 bp, Artificial Sequence
  synthetic sequence
cgtttgtgttccc

SEQ ID NO: 9015 - DNA, 13 bp, Artificial Sequence
  synthetic sequence
gaattcacgatgc

SEQ ID NO: 9016 - DNA, 13 bp, Artificial Sequence
  synthetic sequence
tcgttatcaccag

SEQ ID NO: 9017 - DNA, 13 bp, Artificial Sequence
  synthetic sequence
acaagttcaatag

SEQ ID NO: 9018 - DNA, 13 bp, Artificial Sequence
  synthetic sequence
cagcaaatagggg

SEQ ID NO: 9019 - DNA, 13 bp, Artificial Sequence
  synthetic sequence
aaattcaccgagc

SEQ ID NO: 9020 - DNA, 13 bp, Artificial Sequence
  synthetic sequence
tgtggaacaggga

SEQ ID NO: 9021 - DNA, 13 bp, Artificial Sequence
  synthetic sequence
ccaaaaacgaccc

SEQ ID NO: 9022 - DNA, 13 bp, Artificial Sequence
  synthetic sequence
agcaagggtacct

SEQ ID NO: 9023 - DNA, 13 bp, Artificial Sequence
  synthetic sequence
caattgatggaca

SEQ ID NO: 9024 - DNA, 13 bp, Artificial Sequence
  synthetic sequence
tcccgcaccagat

SEQ ID NO: 9025 - DNA, 13 bp, Artificial Sequence
  synthetic sequence
ttgttgctccctg

SEQ ID NO: 9026 - DNA, 13 bp, Artificial Sequence
  synthetic sequence
gcctggtttgaag

SEQ ID NO: 9027 - DNA, 13 bp, Artificial Sequence
  synthetic sequence
gcgagttcaacgg

SEQ ID NO: 9028 - DNA, 13 bp, Artificial Sequence
  synthetic sequence
gcgtgcagattct

SEQ ID NO: 9029 - DNA, 13 bp, Artificial Sequence
  synthetic sequence
gcataatatccat

SEQ ID NO: 9030 - DNA, 13 bp, Artificial Sequence
  synthetic sequence
tcggtgttttaca

SEQ ID NO: 9031 - DNA, 13 bp, Artificial Sequence
  synthetic sequence
aaatttcaccaag

SEQ ID NO: 9032 - DNA, 13 bp, Artificial Sequence
  synthetic sequence
gattgtggtggta

SEQ ID NO: 9033 - DNA, 13 bp, Artificial Sequence
  synthetic sequence
gcagcagttgctg

SEQ ID NO: 9034 - DNA, 13 bp, Artificial Sequence
  synthetic sequence
ccaaagagatgca

SEQ ID NO: 9035 - DNA, 13 bp, Artificial Sequence
  synthetic sequence
ggatttcagtgtc

SEQ ID NO: 9036 - DNA, 13 bp, Artificial Sequence
  synthetic sequence
aaagtaccactag

SEQ ID NO: 9037 - DNA, 13 bp, Artificial Sequence
  synthetic sequence
tcacaaccccacg

SEQ ID NO: 9038 - DNA, 13 bp, Artificial Sequence
  synthetic sequence
aaggaaatgcaaa

SEQ ID NO: 9039 - DNA, 13 bp, Artificial Sequence
  synthetic sequence
aggaggcagcaaa

SEQ ID NO: 9040 - DNA, 13 bp, Artificial Sequence
  synthetic sequence
catcaacgatagt

SEQ ID NO: 9041 - DNA, 13 bp, Artificial Sequence
  synthetic sequence
tacctttctcttt

SEQ ID NO: 9042 - DNA, 13 bp, Artificial Sequence
  synthetic sequence
ctctgggcaattc

SEQ ID NO: 9043 - DNA, 13 bp, Artificial Sequence
  synthetic sequence
ttgatggtaaaga

SEQ ID NO: 9044 - DNA, 13 bp, Artificial Sequence
  synthetic sequence
ctcacagcaacca

SEQ ID NO: 9045 - DNA, 13 bp, Artificial Sequence
  synthetic sequence
aataatgggcatg

SEQ ID NO: 9046 - DNA, 13 bp, Artificial Sequence
  synthetic sequence
acaacaattgggg

SEQ ID NO: 9047 - DNA, 13 bp, Artificial Sequence
  synthetic sequence
accaagaatgacc

SEQ ID NO: 9048 - DNA, 13 bp, Artificial Sequence
  synthetic sequence
caaaaaggattca

SEQ ID NO: 9049 - DNA, 13 bp, Artificial Sequence
  synthetic sequence
gaacagggatatc

SEQ ID NO: 9050 - DNA, 13 bp, Artificial Sequence
  synthetic sequence
ccaccatacacca

SEQ ID NO: 9051 - DNA, 13 bp, Artificial Sequence
  synthetic sequence
gaatgcatgttgg

SEQ ID NO: 9052 - DNA, 13 bp, Artificial Sequence
  synthetic sequence
acaagaatccagg

SEQ ID NO: 9053 - DNA, 13 bp, Artificial Sequence
  synthetic sequence
tgacaattctaca

SEQ ID NO: 9054 - DNA, 13 bp, Artificial Sequence
  synthetic sequence
ccaccatcagaac

SEQ ID NO: 9055 - DNA, 13 bp, Artificial Sequence
  synthetic sequence
catacaaagatac

SEQ ID NO: 9056 - DNA, 13 bp, Artificial Sequence
  synthetic sequence
gcactcactgcag

SEQ ID NO: 9057 - DNA, 13 bp, Artificial Sequence
  synthetic sequence
ctggaaattccat

SEQ ID NO: 9058 - DNA, 13 bp, Artificial Sequence
  synthetic sequence
tccagttgatgga

SEQ ID NO: 9059 - DNA, 13 bp, Artificial Sequence
  synthetic sequence
acccacatcaaat

SEQ ID NO: 9060 - DNA, 13 bp, Artificial Sequence
  synthetic sequence
tgccaccagatcc

SEQ ID NO: 9061 - DNA, 13 bp, Artificial Sequence
  synthetic sequence
gcagtcccatact

SEQ ID NO: 9062 - DNA, 13 bp, Artificial Sequence
  synthetic sequence
ttgatggcaagga

SEQ ID NO: 9063 - DNA, 13 bp, Artificial Sequence
  synthetic sequence
atgtacggaactg

SEQ ID NO: 9064 - DNA, 13 bp, Artificial Sequence
  synthetic sequence
ccacaatagaatc

SEQ ID NO: 9065 - DNA, 13 bp, Artificial Sequence
  synthetic sequence
cagactagagaca

SEQ ID NO: 9066 - DNA, 13 bp, Artificial Sequence
  synthetic sequence
gattgatagaagc

SEQ ID NO: 9067 - DNA, 13 bp, Artificial Sequence
  synthetic sequence
agatggtgtccac

SEQ ID NO: 9068 - DNA, 13 bp, Artificial Sequence
  synthetic sequence
gctgtgacccaga

SEQ ID NO: 9069 - DNA, 13 bp, Artificial Sequence
  synthetic sequence
cttgtcactatcc

SEQ ID NO: 9070 - DNA, 13 bp, Artificial Sequence
  synthetic sequence
aaatccaggttga

SEQ ID NO: 9071 - DNA, 13 bp, Artificial Sequence
  synthetic sequence
cccaccagccgta

SEQ ID NO: 9072 - DNA, 13 bp, Artificial Sequence
  synthetic sequence
caagacttattga

SEQ ID NO: 9073 - DNA, 13 bp, Artificial Sequence
  synthetic sequence
attaccaggaact

SEQ ID NO: 9074 - DNA, 13 bp, Artificial Sequence
  synthetic sequence
cacatgggaaaat

SEQ ID NO: 9075 - DNA, 13 bp, Artificial Sequence
  synthetic sequence
gtctgtttggaca

SEQ ID NO: 9076 - DNA, 13 bp, Artificial Sequence
  synthetic sequence
aggagatacctgc

SEQ ID NO: 9077 - DNA, 13 bp, Artificial Sequence
  synthetic sequence
cgccctaactttg

SEQ ID NO: 9078 - DNA, 13 bp, Artificial Sequence
  synthetic sequence
gcccctctttacg

SEQ ID NO: 9079 - DNA, 13 bp, Artificial Sequence
  synthetic sequence
caatgtccctacc

SEQ ID NO: 9080 - DNA, 13 bp, Artificial Sequence
  synthetic sequence
acaagaacccagg

SEQ ID NO: 9081 - DNA, 13 bp, Artificial Sequence
  synthetic sequence
tcgacaccatgat

SEQ ID NO: 9082 - DNA, 13 bp, Artificial Sequence
  synthetic sequence
ggtgagaaaggag

SEQ ID NO: 9083 - DNA, 13 bp, Artificial Sequence
  synthetic sequence
caaattggagaca

SEQ ID NO: 9084 - DNA, 13 bp, Artificial Sequence
  synthetic sequence
taccaccacagtg

SEQ ID NO: 9085 - DNA, 13 bp, Artificial Sequence
  synthetic sequence
aacaatggacatg

SEQ ID NO: 9086 - DNA, 13 bp, Artificial Sequence
  synthetic sequence
cagtatgtttatt

SEQ ID NO: 9087 - DNA, 13 bp, Artificial Sequence
  synthetic sequence
cactaccacagtg

SEQ ID NO: 9088 - DNA, 13 bp, Artificial Sequence
  synthetic sequence
atccagtggatca

SEQ ID NO: 9089 - DNA, 13 bp, Artificial Sequence
  synthetic sequence
ctgtgaaaagaag

SEQ ID NO: 9090 - DNA, 13 bp, Artificial Sequence
  synthetic sequence
tgtggaatagaga

SEQ ID NO: 9091 - DNA, 13 bp, Artificial Sequence
  synthetic sequence
cagttccagaaat

SEQ ID NO: 9092 - DNA, 13 bp, Artificial Sequence
  synthetic sequence
tgtgaattcaatg

SEQ ID NO: 9093 - DNA, 13 bp, Artificial Sequence
  synthetic sequence
ggagactgcggtg

SEQ ID NO: 9094 - DNA, 13 bp, Artificial Sequence
  synthetic sequence
agtttagagatat

SEQ ID NO: 9095 - DNA, 13 bp, Artificial Sequence
  synthetic sequence
gatttgcaccact

SEQ ID NO: 9096 - DNA, 13 bp, Artificial Sequence
  synthetic sequence
gggtgatagttgg

SEQ ID NO: 9097 - DNA, 13 bp, Artificial Sequence
  synthetic sequence
ccatggagcaggg

SEQ ID NO: 9098 - DNA, 13 bp, Artificial Sequence
  synthetic sequence
taattgaagcttc

SEQ ID NO: 9099 - DNA, 13 bp, Artificial Sequence
  synthetic sequence
ctgctgtggctgg

SEQ ID NO: 9100 - DNA, 13 bp, Artificial Sequence
  synthetic sequence
gtgtttgaaggtg

SEQ ID NO: 9101 - DNA, 13 bp, Artificial Sequence
  synthetic sequence
tcattgattggtt

SEQ ID NO: 9102 - DNA, 13 bp, Artificial Sequence
  synthetic sequence
tctcaacagttat

SEQ ID NO: 9103 - DNA, 13 bp, Artificial Sequence
  synthetic sequence
tcaggacactctt

SEQ ID NO: 9104 - DNA, 13 bp, Artificial Sequence
  synthetic sequence
acgggagccacaa

SEQ ID NO: 9105 - DNA, 13 bp, Artificial Sequence
  synthetic sequence
aattgcatggagg

SEQ ID NO: 9106 - DNA, 13 bp, Artificial Sequence
  synthetic sequence
actagcaagggag

SEQ ID NO: 9107 - DNA, 13 bp, Artificial Sequence
  synthetic sequence
tggataagtcttc

SEQ ID NO: 9108 - DNA, 13 bp, Artificial Sequence
  synthetic sequence
aacaagaaaccca

SEQ ID NO: 9109 - DNA, 13 bp, Artificial Sequence
  synthetic sequence
gggtccaccatca

SEQ ID NO: 9110 - DNA, 13 bp, Artificial Sequence
  synthetic sequence
tttggtcaaaaca

SEQ ID NO: 9111 - DNA, 13 bp, Artificial Sequence
  synthetic sequence
atgatagtttcac

SEQ ID NO: 9112 - DNA, 13 bp, Artificial Sequence
  synthetic sequence
accagaaactatg

SEQ ID NO: 9113 - DNA, 13 bp, Artificial Sequence
  synthetic sequence
agaatacaaaagc

SEQ ID NO: 9114 - DNA, 13 bp, Artificial Sequence
  synthetic sequence
ggtagcaaccaat

SEQ ID NO: 9115 - DNA, 13 bp, Artificial Sequence
  synthetic sequence
aatcactcacatc

SEQ ID NO: 9116 - DNA, 13 bp, Artificial Sequence
  synthetic sequence
gagagttcaccat

SEQ ID NO: 9117 - DNA, 13 bp, Artificial Sequence
  synthetic sequence
atgggtttgcatc

SEQ ID NO: 9118 - DNA, 13 bp, Artificial Sequence
  synthetic sequence
gattatctcaacc

SEQ ID NO: 9119 - DNA, 13 bp, Artificial Sequence
  synthetic sequence
catacgtcatgcg

SEQ ID NO: 9120 - DNA, 13 bp, Artificial Sequence
  synthetic sequence
tgctggagaacca

SEQ ID NO: 9121 - DNA, 13 bp, Artificial Sequence
  synthetic sequence
accagtatgtctg

SEQ ID NO: 9122 - DNA, 13 bp, Artificial Sequence
  synthetic sequence
ccactatatgcac

SEQ ID NO: 9123 - DNA, 13 bp, Artificial Sequence
  synthetic sequence
gtgtttgaaggag

SEQ ID NO: 9124 - DNA, 13 bp, Artificial Sequence
  synthetic sequence
gcatggttcgagg

SEQ ID NO: 9125 - DNA, 13 bp, Artificial Sequence
  synthetic sequence
agcatggttacta

SEQ ID NO: 9126 - DNA, 13 bp, Artificial Sequence
  synthetic sequence
cccaataagagac

SEQ ID NO: 9127 - DNA, 13 bp, Artificial Sequence
  synthetic sequence
agggttagataca

SEQ ID NO: 9128 - DNA, 13 bp, Artificial Sequence
  synthetic sequence
gaagcatccagtc

SEQ ID NO: 9129 - DNA, 13 bp, Artificial Sequence
  synthetic sequence
tgaccagcatggt

SEQ ID NO: 9130 - DNA, 13 bp, Artificial Sequence
  synthetic sequence
aaatcccgtacgt

SEQ ID NO: 9131 - DNA, 13 bp, Artificial Sequence
  synthetic sequence
accacctgtacaa

SEQ ID NO: 9132 - DNA, 13 bp, Artificial Sequence
  synthetic sequence
tttgagggtgtga

SEQ ID NO: 9133 - DNA, 13 bp, Artificial Sequence
  synthetic sequence
aaagctgtgtaca

SEQ ID NO: 9134 - DNA, 13 bp, Artificial Sequence
  synthetic sequence
accaaaagtgatc

SEQ ID NO: 9135 - DNA, 13 bp, Artificial Sequence
  synthetic sequence
ccaggggattgtg

SEQ ID NO: 9136 - DNA, 13 bp, Artificial Sequence
  synthetic sequence
ccaagttcactga

SEQ ID NO: 9137 - DNA, 13 bp, Artificial Sequence
  synthetic sequence
gaagccatggaac

SEQ ID NO: 9138 - DNA, 13 bp, Artificial Sequence
  synthetic sequence
gctatggagcaag

SEQ ID NO: 9139 - DNA, 13 bp, Artificial Sequence
  synthetic sequence
ggtgaattcaaag

SEQ ID NO: 9140 - DNA, 13 bp, Artificial Sequence
  synthetic sequence
agatgtgcaagaa

SEQ ID NO: 9141 - DNA, 13 bp, Artificial Sequence
  synthetic sequence
atttccaagttca

SEQ ID NO: 9142 - DNA, 13 bp, Artificial Sequence
  synthetic sequence
gggacatcagacc

SEQ ID NO: 9143 - DNA, 13 bp, Artificial Sequence
  synthetic sequence
atccttggttttg

SEQ ID NO: 9144 - DNA, 13 bp, Artificial Sequence
  synthetic sequence
aaattccaccatt

SEQ ID NO: 9145 - DNA, 13 bp, Artificial Sequence
  synthetic sequence
tggaagagcttta

SEQ ID NO: 9146 - DNA, 13 bp, Artificial Sequence
  synthetic sequence
ccttaggtgtcaa

SEQ ID NO: 9147 - DNA, 13 bp, Artificial Sequence
  synthetic sequence
gagtagtcaatga

SEQ ID NO: 9148 - DNA, 13 bp, Artificial Sequence
  synthetic sequence
ctggaaaatcaaa

SEQ ID NO: 9149 - DNA, 13 bp, Artificial Sequence
  synthetic sequence
tgcacggcagtcc

SEQ ID NO: 9150 - DNA, 13 bp, Artificial Sequence
  synthetic sequence
gttctgtggatcc

SEQ ID NO: 9151 - DNA, 13 bp, Artificial Sequence
  synthetic sequence
ctactttcgctgc

SEQ ID NO: 9152 - DNA, 13 bp, Artificial Sequence
  synthetic sequence
atgcatttgttta

SEQ ID NO: 9153 - DNA, 13 bp, Artificial Sequence
  synthetic sequence
cgatgtgttgtga

SEQ ID NO: 9154 - DNA, 13 bp, Artificial Sequence
  synthetic sequence
tcgggatgcacgt

SEQ ID NO: 9155 - DNA, 13 bp, Artificial Sequence
  synthetic sequence
aaaaacaatacga

SEQ ID NO: 9156 - DNA, 13 bp, Artificial Sequence
  synthetic sequence
ctagtattgagtc

SEQ ID NO: 9157 - DNA, 13 bp, Artificial Sequence
  synthetic sequence
cgaccccatactc

SEQ ID NO: 9158 - DNA, 13 bp, Artificial Sequence
  synthetic sequence
tgtgggggcattt

SEQ ID NO: 9159 - DNA, 13 bp, Artificial Sequence
  synthetic sequence
aaggagacagttg

SEQ ID NO: 9160 - DNA, 13 bp, Artificial Sequence
  synthetic sequence
ccatatgtcatgc

SEQ ID NO: 9161 - DNA, 13 bp, Artificial Sequence
  synthetic sequence
atgatagcttcac

SEQ ID NO: 9162 - DNA, 13 bp, Artificial Sequence
  synthetic sequence
tggacgccaaagc

SEQ ID NO: 9163 - DNA, 13 bp, Artificial Sequence
  synthetic sequence
tgcagctgagaag

SEQ ID NO: 9164 - DNA, 13 bp, Artificial Sequence
  synthetic sequence
aaatgtgcaaaaa

SEQ ID NO: 9165 - DNA, 13 bp, Artificial Sequence
  synthetic sequence
atgactatcctgc

SEQ ID NO: 9166 - DNA, 13 bp, Artificial Sequence
  synthetic sequence
cagatatcagaga

SEQ ID NO: 9167 - DNA, 13 bp, Artificial Sequence
  synthetic sequence
tccaccgtggaat

SEQ ID NO: 9168 - DNA, 13 bp, Artificial Sequence
  synthetic sequence
accaggaattatg

SEQ ID NO: 9169 - DNA, 13 bp, Artificial Sequence
  synthetic sequence
atatctatagtgt

SEQ ID NO: 9170 - DNA, 13 bp, Artificial Sequence
  synthetic sequence
aattcacaatgct

SEQ ID NO: 9171 - DNA, 13 bp, Artificial Sequence
  synthetic sequence
gtaactgagcagg

SEQ ID NO: 9172 - DNA, 13 bp, Artificial Sequence
  synthetic sequence
acagttgcacaca

SEQ ID NO: 9173 - DNA, 13 bp, Artificial Sequence
  synthetic sequence
gtaatgcgtttgt

SEQ ID NO: 9174 - DNA, 13 bp, Artificial Sequence
  synthetic sequence
cgatcctgtgtct

SEQ ID NO: 9175 - DNA, 13 bp, Artificial Sequence
  synthetic sequence
agcccgatgtagc

SEQ ID NO: 9176 - DNA, 13 bp, Artificial Sequence
  synthetic sequence
tagagaatcagat

SEQ ID NO: 9177 - DNA, 13 bp, Artificial Sequence
  synthetic sequence
gttttcggtttgg

SEQ ID NO: 9178 - DNA, 13 bp, Artificial Sequence
  synthetic sequence
cacacggacgatc

SEQ ID NO: 9179 - DNA, 13 bp, Artificial Sequence
  synthetic sequence
cactaccaccaga

SEQ ID NO: 9180 - DNA, 13 bp, Artificial Sequence
  synthetic sequence
gacgccaaagccc

SEQ ID NO: 9181 - DNA, 13 bp, Artificial Sequence
  synthetic sequence
gaagcagtggatc

SEQ ID NO: 9182 - DNA, 13 bp, Artificial Sequence
  synthetic sequence
gagcaatgacaat

SEQ ID NO: 9183 - DNA, 13 bp, Artificial Sequence
  synthetic sequence
gaatcaccccacc

SEQ ID NO: 9184 - DNA, 13 bp, Artificial Sequence
  synthetic sequence
ctgatggacaaat

SEQ ID NO: 9185 - DNA, 13 bp, Artificial Sequence
  synthetic sequence
acccatcaatttt

SEQ ID NO: 9186 - DNA, 13 bp, Artificial Sequence
  synthetic sequence
aaagttgagcaag

SEQ ID NO: 9187 - DNA, 13 bp, Artificial Sequence
  synthetic sequence
cccactttccagt

SEQ ID NO: 9188 - DNA, 13 bp, Artificial Sequence
  synthetic sequence
tgattacacaggc

SEQ ID NO: 9189 - DNA, 13 bp, Artificial Sequence
  synthetic sequence
ttagaactgccaa

SEQ ID NO: 9190 - DNA, 13 bp, Artificial Sequence
  synthetic sequence
catcaaggatgtg

SEQ ID NO: 9191 - DNA, 13 bp, Artificial Sequence
  synthetic sequence
atgtgatatggga

SEQ ID NO: 9192 - DNA, 13 bp, Artificial Sequence
  synthetic sequence
atatccaagttca

SEQ ID NO: 9193 - DNA, 13 bp, Artificial Sequence
  synthetic sequence
ggactcccaaaca

SEQ ID NO: 9194 - DNA, 13 bp, Artificial Sequence
  synthetic sequence
aaaatcaaattgc

SEQ ID NO: 9195 - DNA, 13 bp, Artificial Sequence
  synthetic sequence
acaggaaaatcag

SEQ ID NO: 9196 - DNA, 13 bp, Artificial Sequence
  synthetic sequence
tcaccagaaacta

SEQ ID NO: 9197 - DNA, 13 bp, Artificial Sequence
  synthetic sequence
cggtggacgacaa

SEQ ID NO: 9198 - DNA, 13 bp, Artificial Sequence
  synthetic sequence
accattcacacca

SEQ ID NO: 9199 - DNA, 13 bp, Artificial Sequence
  synthetic sequence
tttcagtacatgg

SEQ ID NO: 9200 - DNA, 13 bp, Artificial Sequence
  synthetic sequence
gatcaccaaaaat

SEQ ID NO: 9201 - DNA, 13 bp, Artificial Sequence
  synthetic sequence
tggacgcaaaagc

SEQ ID NO: 9202 - DNA, 13 bp, Artificial Sequence
  synthetic sequence
agtaatcagtacc

SEQ ID NO: 9203 - DNA, 13 bp, Artificial Sequence
  synthetic sequence
tcctagaaacact

SEQ ID NO: 9204 - DNA, 13 bp, Artificial Sequence
  synthetic sequence
gatcggagacaaa

SEQ ID NO: 9205 - DNA, 13 bp, Artificial Sequence
  synthetic sequence
aggccattcagct

SEQ ID NO: 9206 - DNA, 13 bp, Artificial Sequence
  synthetic sequence
caactacatcgat

SEQ ID NO: 9207 - DNA, 13 bp, Artificial Sequence
  synthetic sequence
tcaccatgttggg

SEQ ID NO: 9208 - DNA, 13 bp, Artificial Sequence
  synthetic sequence
tgttggagaatca

SEQ ID NO: 9209 - DNA, 13 bp, Artificial Sequence
  synthetic sequence
gcagttgaggcaa

SEQ ID NO: 9210 - DNA, 13 bp, Artificial Sequence
  synthetic sequence
cgaatcattcttt

SEQ ID NO: 9211 - DNA, 13 bp, Artificial Sequence
  synthetic sequence
ctacggccctgga

SEQ ID NO: 9212 - DNA, 13 bp, Artificial Sequence
  synthetic sequence
tcactcacaccat

SEQ ID NO: 9213 - DNA, 13 bp, Artificial Sequence
  synthetic sequence
gccatgtacggta

SEQ ID NO: 9214 - DNA, 13 bp, Artificial Sequence
  synthetic sequence
cacagtagaattc

SEQ ID NO: 9215 - DNA, 13 bp, Artificial Sequence
  synthetic sequence
tgtatggtactga

SEQ ID NO: 9216 - DNA, 13 bp, Artificial Sequence
  synthetic sequence
cacaccgatcttg

SEQ ID NO: 9217 - DNA, 13 bp, Artificial Sequence
  synthetic sequence
attagtgttaccc

SEQ ID NO: 9218 - DNA, 13 bp, Artificial Sequence
  synthetic sequence
aaatcaccgaaac

SEQ ID NO: 9219 - DNA, 13 bp, Artificial Sequence
  synthetic sequence
cagttgactccca

SEQ ID NO: 9220 - DNA, 13 bp, Artificial Sequence
  synthetic sequence
ctaaccagtatgg

SEQ ID NO: 9221 - DNA, 13 bp, Artificial Sequence
  synthetic sequence
gagcttctttgcg

SEQ ID NO: 9222 - DNA, 13 bp, Artificial Sequence
  synthetic sequence
ctcagggcacaga

SEQ ID NO: 9223 - DNA, 13 bp, Artificial Sequence
  synthetic sequence
ctcggttagtcaa

SEQ ID NO: 9224 - DNA, 13 bp, Artificial Sequence
  synthetic sequence
ctcacgcggttga

SEQ ID NO: 9225 - DNA, 13 bp, Artificial Sequence
  synthetic sequence
ttgggagtggagt

SEQ ID NO: 9226 - DNA, 13 bp, Artificial Sequence
  synthetic sequence
tcactccacccac

SEQ ID NO: 9227 - DNA, 13 bp, Artificial Sequence
  synthetic sequence
tacgcggtagaag

SEQ ID NO: 9228 - DNA, 13 bp, Artificial Sequence
  synthetic sequence
caatccagtggac

SEQ ID NO: 9229 - DNA, 13 bp, Artificial Sequence
  synthetic sequence
agaatccaaaagt

SEQ ID NO: 9230 - DNA, 13 bp, Artificial Sequence
  synthetic sequence
ctctctcaataga

SEQ ID NO: 9231 - DNA, 13 bp, Artificial Sequence
  synthetic sequence
cggacaattacca

SEQ ID NO: 9232 - DNA, 13 bp, Artificial Sequence
  synthetic sequence
ttttatgatggtt

SEQ ID NO: 9233 - DNA, 13 bp, Artificial Sequence
  synthetic sequence
ccagcctggttcg

SEQ ID NO: 9234 - DNA, 13 bp, Artificial Sequence
  synthetic sequence
gagatcttagatg

SEQ ID NO: 9235 - DNA, 13 bp, Artificial Sequence
  synthetic sequence
gacaattgtacca

SEQ ID NO: 9236 - DNA, 13 bp, Artificial Sequence
  synthetic sequence
ctggaaaataact

SEQ ID NO: 9237 - DNA, 13 bp, Artificial Sequence
  synthetic sequence
tttcaatatatgg

SEQ ID NO: 9238 - DNA, 13 bp, Artificial Sequence
  synthetic sequence
caatgactattct

SEQ ID NO: 9239 - DNA, 13 bp, Artificial Sequence
  synthetic sequence
agccagcagtcct

SEQ ID NO: 9240 - DNA, 13 bp, Artificial Sequence
  synthetic sequence
aaacagagcttat

SEQ ID NO: 9241 - DNA, 13 bp, Artificial Sequence
  synthetic sequence
gttgaacagggaa

SEQ ID NO: 9242 - DNA, 13 bp, Artificial Sequence
  synthetic sequence
tggccaaaacatg

SEQ ID NO: 9243 - DNA, 13 bp, Artificial Sequence
  synthetic sequence
gattggagacaag

SEQ ID NO: 9244 - DNA, 13 bp, Artificial Sequence
  synthetic sequence
ggtttgctcctct

SEQ ID NO: 9245 - DNA, 13 bp, Artificial Sequence
  synthetic sequence
acacaaaagaaat

SEQ ID NO: 9246 - DNA, 13 bp, Artificial Sequence
  synthetic sequence
gaaaaccagatat

SEQ ID NO: 9247 - DNA, 13 bp, Artificial Sequence
  synthetic sequence
gcacgttcactcc

SEQ ID NO: 9248 - DNA, 13 bp, Artificial Sequence
  synthetic sequence
cgtgcactgggaa

SEQ ID NO: 9249 - DNA, 13 bp, Artificial Sequence
  synthetic sequence
ttaaagacgtcct

SEQ ID NO: 9250 - DNA, 13 bp, Artificial Sequence
  synthetic sequence
aatcaccgagacg

SEQ ID NO: 9251 - DNA, 13 bp, Artificial Sequence
  synthetic sequence
caaataaacgacc

SEQ ID NO: 9252 - DNA, 13 bp, Artificial Sequence
  synthetic sequence
gtatttgaagggg

SEQ ID NO: 9253 - DNA, 13 bp, Artificial Sequence
  synthetic sequence
tagcatagagtct

SEQ ID NO: 9254 - DNA, 13 bp, Artificial Sequence
  synthetic sequence
actagaaattacg

SEQ ID NO: 9255 - DNA, 13 bp, Artificial Sequence
  synthetic sequence
gtgtgccaatcgg

SEQ ID NO: 9256 - DNA, 13 bp, Artificial Sequence
  synthetic sequence
ggaggctatggaa

SEQ ID NO: 9257 - DNA, 13 bp, Artificial Sequence
  synthetic sequence
tgtggaattcatt

SEQ ID NO: 9258 - DNA, 13 bp, Artificial Sequence
  synthetic sequence
ttccagtacatgg

SEQ ID NO: 9259 - DNA, 13 bp, Artificial Sequence
  synthetic sequence
aggaagtggaggt

SEQ ID NO: 9260 - DNA, 13 bp, Artificial Sequence
  synthetic sequence
ccaaggagatgca

SEQ ID NO: 9261 - DNA, 13 bp, Artificial Sequence
  synthetic sequence
actaggaactatg

SEQ ID NO: 9262 - DNA, 13 bp, Artificial Sequence
  synthetic sequence
aaggaaccagccg

SEQ ID NO: 9263 - DNA, 13 bp, Artificial Sequence
  synthetic sequence
tgtcatgcgtcaa

SEQ ID NO: 9264 - DNA, 13 bp, Artificial Sequence
  synthetic sequence
tgacgcatctctc

SEQ ID NO: 9265 - DNA, 13 bp, Artificial Sequence
  synthetic sequence
tcttactgaaaac

SEQ ID NO: 9266 - DNA, 13 bp, Artificial Sequence
  synthetic sequence
ttacctcaaacta

SEQ ID NO: 9267 - DNA, 13 bp, Artificial Sequence
  synthetic sequence
ttccatactacgg

SEQ ID NO: 9268 - DNA, 13 bp, Artificial Sequence
  synthetic sequence
agtatctaactgc

SEQ ID NO: 9269 - DNA, 13 bp, Artificial Sequence
  synthetic sequence
tggatgctaaagc

SEQ ID NO: 9270 - DNA, 13 bp, Artificial Sequence
  synthetic sequence
tttcaatacatgg

SEQ ID NO: 9271 - DNA, 13 bp, Artificial Sequence
  synthetic sequence
agaaccagattgc

SEQ ID NO: 9272 - DNA, 13 bp, Artificial Sequence
  synthetic sequence
ggctatgaccatt

SEQ ID NO: 9273 - DNA, 13 bp, Artificial Sequence
  synthetic sequence
gtggaaacagggg

SEQ ID NO: 9274 - DNA, 13 bp, Artificial Sequence
  synthetic sequence
tcgccccactcta

SEQ ID NO: 9275 - DNA, 13 bp, Artificial Sequence
  synthetic sequence
aagaatcgcaaag

SEQ ID NO: 9276 - DNA, 13 bp, Artificial Sequence
  synthetic sequence
ttttggagatccc

SEQ ID NO: 9277 - DNA, 13 bp, Artificial Sequence
  synthetic sequence
agaactgctaaag

SEQ ID NO: 9278 - DNA, 13 bp, Artificial Sequence
  synthetic sequence
ctatcagaactgc

SEQ ID NO: 9279 - DNA, 13 bp, Artificial Sequence
  synthetic sequence
ccatgcttggagt

SEQ ID NO: 9280 - DNA, 13 bp, Artificial Sequence
  synthetic sequence
ttctagtgagata

SEQ ID NO: 9281 - DNA, 13 bp, Artificial Sequence
  synthetic sequence
ctgagtacaattt

SEQ ID NO: 9282 - DNA, 13 bp, Artificial Sequence
  synthetic sequence
tgcaagcagtaac

SEQ ID NO: 9283 - DNA, 13 bp, Artificial Sequence
  synthetic sequence
tggtttgaagctc

SEQ ID NO: 9284 - DNA, 13 bp, Artificial Sequence
  synthetic sequence
cttagatgccaac

SEQ ID NO: 9285 - DNA, 13 bp, Artificial Sequence
  synthetic sequence
cgtaccggcaaac

SEQ ID NO: 9286 - DNA, 13 bp, Artificial Sequence
  synthetic sequence
tctaagtttatag

SEQ ID NO: 9287 - DNA, 13 bp, Artificial Sequence
  synthetic sequence
tggaaaaccagat

SEQ ID NO: 9288 - DNA, 13 bp, Artificial Sequence
  synthetic sequence
gaaaggccatcca

SEQ ID NO: 9289 - DNA, 13 bp, Artificial Sequence
  synthetic sequence
ccagcatggtaac

SEQ ID NO: 9290 - DNA, 13 bp, Artificial Sequence
  synthetic sequence
gagatgtgtaaaa

SEQ ID NO: 9291 - DNA, 13 bp, Artificial Sequence
  synthetic sequence
ttggcgtccatga

SEQ ID NO: 9292 - DNA, 13 bp, Artificial Sequence
  synthetic sequence
gaaaaatttaccc

SEQ ID NO: 9293 - DNA, 13 bp, Artificial Sequence
  synthetic sequence
aaacacggacacc

SEQ ID NO: 9294 - DNA, 13 bp, Artificial Sequence
  synthetic sequence
ggattagccgcat

SEQ ID NO: 9295 - DNA, 13 bp, Artificial Sequence
  synthetic sequence
tgctccgggtggt

SEQ ID NO: 9296 - DNA, 13 bp, Artificial Sequence
  synthetic sequence
ctcttgaactgta

SEQ ID NO: 9297 - DNA, 13 bp, Artificial Sequence
  synthetic sequence
gaagtgcttgttc

SEQ ID NO: 9298 - DNA, 13 bp, Artificial Sequence
  synthetic sequence
gctgagcgcaacg

SEQ ID NO: 9299 - DNA, 13 bp, Artificial Sequence
  synthetic sequence
gtagggttactaa

SEQ ID NO: 9300 - DNA, 13 bp, Artificial Sequence
  synthetic sequence
gttagtccatagt

SEQ ID NO: 9301 - DNA, 13 bp, Artificial Sequence
  synthetic sequence
ctagtgttcacga

SEQ ID NO: 9302 - DNA, 13 bp, Artificial Sequence
  synthetic sequence
catcaccataggc

SEQ ID NO: 9303 - DNA, 13 bp, Artificial Sequence
  synthetic sequence
gtgtagtaattta

SEQ ID NO: 9304 - DNA, 13 bp, Artificial Sequence
  synthetic sequence
tctgagtgaagta

SEQ ID NO: 9305 - DNA, 13 bp, Artificial Sequence
  synthetic sequence
agtttgctggttg

SEQ ID NO: 9306 - DNA, 13 bp, Artificial Sequence
  synthetic sequence
tctgtgatgaaac

SEQ ID NO: 9307 - DNA, 13 bp, Artificial Sequence
  synthetic sequence
ggaaagttgtaca

SEQ ID NO: 9308 - DNA, 13 bp, Artificial Sequence
  synthetic sequence
tcattggcattac

SEQ ID NO: 9309 - DNA, 13 bp, Artificial Sequence
  synthetic sequence
tagcacagttgtt

SEQ ID NO: 9310 - DNA, 13 bp, Artificial Sequence
  synthetic sequence
gatcttctgtttc

SEQ ID NO: 9311 - DNA, 13 bp, Artificial Sequence
  synthetic sequence
tgcaccttgcgat

SEQ ID NO: 9312 - DNA, 13 bp, Artificial Sequence
  synthetic sequence
gtgaatttcttca

SEQ ID NO: 9313 - DNA, 13 bp, Artificial Sequence
  synthetic sequence
aaattgaagtgcc

SEQ ID NO: 9314 - DNA, 13 bp, Artificial Sequence
  synthetic sequence
ttctttcccattg

SEQ ID NO: 9315 - DNA, 13 bp, Artificial Sequence
  synthetic sequence
tggaggtgttctc

SEQ ID NO: 9316 - DNA, 13 bp, Artificial Sequence
  synthetic sequence
tttcttttagcca

SEQ ID NO: 9317 - DNA, 13 bp, Artificial Sequence
  synthetic sequence
ctgtttgaacctg

SEQ ID NO: 9318 - DNA, 13 bp, Artificial Sequence
  synthetic sequence
attcttcttcgcc

SEQ ID NO: 9319 - DNA, 13 bp, Artificial Sequence
  synthetic sequence
ccatgtcaaatct

SEQ ID NO: 9320 - DNA, 13 bp, Artificial Sequence
  synthetic sequence
acattgttgaata

SEQ ID NO: 9321 - DNA, 13 bp, Artificial Sequence
  synthetic sequence
aaaatgcaaccaa

SEQ ID NO: 9322 - DNA, 13 bp, Artificial Sequence
  synthetic sequence
catcaaactcagg

SEQ ID NO: 9323 - DNA, 13 bp, Artificial Sequence
  synthetic sequence
tcttcttgtgtag

SEQ ID NO: 9324 - DNA, 13 bp, Artificial Sequence
  synthetic sequence
tgagcccatcttt

SEQ ID NO: 9325 - DNA, 13 bp, Artificial Sequence
  synthetic sequence
acatgtccattgt

SEQ ID NO: 9326 - DNA, 13 bp, Artificial Sequence
  synthetic sequence
accaccaccctct

SEQ ID NO: 9327 - DNA, 13 bp, Artificial Sequence
  synthetic sequence
cattgtccacctc

SEQ ID NO: 9328 - DNA, 13 bp, Artificial Sequence
  synthetic sequence
tgaatccactacc

SEQ ID NO: 9329 - DNA, 13 bp, Artificial Sequence
  synthetic sequence
aatgccattctca

SEQ ID NO: 9330 - DNA, 13 bp, Artificial Sequence
  synthetic sequence
ttctgggtgtgga

SEQ ID NO: 9331 - DNA, 13 bp, Artificial Sequence
  synthetic sequence
ttccttgtggcat

SEQ ID NO: 9332 - DNA, 13 bp, Artificial Sequence
  synthetic sequence
tcatgtacactct

SEQ ID NO: 9333 - DNA, 13 bp, Artificial Sequence
  synthetic sequence
ggtaatattcatt

SEQ ID NO: 9334 - DNA, 13 bp, Artificial Sequence
  synthetic sequence
cagccctcccaag

SEQ ID NO: 9335 - DNA, 13 bp, Artificial Sequence
  synthetic sequence
tgctttcaccagg

SEQ ID NO: 9336 - DNA, 13 bp, Artificial Sequence
  synthetic sequence
ctgatattcttgc

SEQ ID NO: 9337 - DNA, 13 bp, Artificial Sequence
  synthetic sequence
ccaaggtaccacc

SEQ ID NO: 9338 - DNA, 13 bp, Artificial Sequence
  synthetic sequence
acatgtgagttgt

SEQ ID NO: 9339 - DNA, 13 bp, Artificial Sequence
  synthetic sequence
ctataaccacacg

SEQ ID NO: 9340 - DNA, 13 bp, Artificial Sequence
  synthetic sequence
attcaggccatct

SEQ ID NO: 9341 - DNA, 13 bp, Artificial Sequence
  synthetic sequence
acagtgatgttgc

SEQ ID NO: 9342 - DNA, 13 bp, Artificial Sequence
  synthetic sequence
gtggaagattcag

SEQ ID NO: 9343 - DNA, 13 bp, Artificial Sequence
  synthetic sequence
cactgccacggtg

SEQ ID NO: 9344 - DNA, 13 bp, Artificial Sequence
  synthetic sequence
cacatttgttctg

SEQ ID NO: 9345 - DNA, 13 bp, Artificial Sequence
  synthetic sequence
gtttgcacggtgt

SEQ ID NO: 9346 - DNA, 13 bp, Artificial Sequence
  synthetic sequence
aggtcatccataa

SEQ ID NO: 9347 - DNA, 13 bp, Artificial Sequence
  synthetic sequence
agcaacttctctg

SEQ ID NO: 9348 - DNA, 13 bp, Artificial Sequence
  synthetic sequence
gcttctcttccat

SEQ ID NO: 9349 - DNA, 13 bp, Artificial Sequence
  synthetic sequence
ggtaatcaactgg

SEQ ID NO: 9350 - DNA, 13 bp, Artificial Sequence
  synthetic sequence
ccgtacaacgaat

SEQ ID NO: 9351 - DNA, 13 bp, Artificial Sequence
  synthetic sequence
ttggttttggacg

SEQ ID NO: 9352 - DNA, 13 bp, Artificial Sequence
  synthetic sequence
actctaatttgtc

SEQ ID NO: 9353 - DNA, 13 bp, Artificial Sequence
  synthetic sequence
cagtggttccaac

SEQ ID NO: 9354 - DNA, 13 bp, Artificial Sequence
  synthetic sequence
atgcctttctctt

SEQ ID NO: 9355 - DNA, 13 bp, Artificial Sequence
  synthetic sequence
atccgattttctc

SEQ ID NO: 9356 - DNA, 13 bp, Artificial Sequence
  synthetic sequence
ttgtacataacgt

SEQ ID NO: 9357 - DNA, 13 bp, Artificial Sequence
  synthetic sequence
cgctcatgacttg

SEQ ID NO: 9358 - DNA, 13 bp, Artificial Sequence
  synthetic sequence
acataatttggta

SEQ ID NO: 9359 - DNA, 13 bp, Artificial Sequence
  synthetic sequence
catacttagagaa

SEQ ID NO: 9360 - DNA, 13 bp, Artificial Sequence
  synthetic sequence
tacatttccatgg

SEQ ID NO: 9361 - DNA, 13 bp, Artificial Sequence
  synthetic sequence
cgttgatacactc

SEQ ID NO: 9362 - DNA, 13 bp, Artificial Sequence
  synthetic sequence
tgatagctggtgt

SEQ ID NO: 9363 - DNA, 13 bp, Artificial Sequence
  synthetic sequence
catgtctggtttg

SEQ ID NO: 9364 - DNA, 13 bp, Artificial Sequence
  synthetic sequence
accaccaccctcg

SEQ ID NO: 9365 - DNA, 13 bp, Artificial Sequence
  synthetic sequence
tcaggccaacgcc

SEQ ID NO: 9366 - DNA, 13 bp, Artificial Sequence
  synthetic sequence
tgaatgtccatgt

SEQ ID NO: 9367 - DNA, 13 bp, Artificial Sequence
  synthetic sequence
tacccggacctac

SEQ ID NO: 9368 - DNA, 13 bp, Artificial Sequence
  synthetic sequence
cactggcttcagt

SEQ ID NO: 9369 - DNA, 13 bp, Artificial Sequence
  synthetic sequence
cgggtatgtcaat

SEQ ID NO: 9370 - DNA, 13 bp, Artificial Sequence
  synthetic sequence
gtttggtagaaga

SEQ ID NO: 9371 - DNA, 13 bp, Artificial Sequence
  synthetic sequence
ttttagatacact

SEQ ID NO: 9372 - DNA, 13 bp, Artificial Sequence
  synthetic sequence
ggaggcgcgtatg

SEQ ID NO: 9373 - DNA, 13 bp, Artificial Sequence
  synthetic sequence
agggagtcaccta

SEQ ID NO: 9374 - DNA, 13 bp, Artificial Sequence
  synthetic sequence
aagccattctcat

SEQ ID NO: 9375 - DNA, 13 bp, Artificial Sequence
  synthetic sequence
tatacccgcaagc

SEQ ID NO: 9376 - DNA, 13 bp, Artificial Sequence
  synthetic sequence
tcttgagagaagt

SEQ ID NO: 9377 - DNA, 13 bp, Artificial Sequence
  synthetic sequence
ggcactaccatag

SEQ ID NO: 9378 - DNA, 13 bp, Artificial Sequence
  synthetic sequence
gtggagaggggtg

SEQ ID NO: 9379 - DNA, 13 bp, Artificial Sequence
  synthetic sequence
cctaacccctgtg

SEQ ID NO: 9380 - DNA, 13 bp, Artificial Sequence
  synthetic sequence
gtgatgtctggtt

SEQ ID NO: 9381 - DNA, 13 bp, Artificial Sequence
  synthetic sequence
tcactagcaaaat

SEQ ID NO: 9382 - DNA, 13 bp, Artificial Sequence
  synthetic sequence
tttcatttctctt

SEQ ID NO: 9383 - DNA, 13 bp, Artificial Sequence
  synthetic sequence
taagttcatcctt

SEQ ID NO: 9384 - DNA, 13 bp, Artificial Sequence
  synthetic sequence
taaacacactcaa

SEQ ID NO: 9385 - DNA, 13 bp, Artificial Sequence
  synthetic sequence
cgttttgcaaatc

SEQ ID NO: 9386 - DNA, 13 bp, Artificial Sequence
  synthetic sequence
atgtcaatcttca

SEQ ID NO: 9387 - DNA, 13 bp, Artificial Sequence
  synthetic sequence
ggtacctagctgg

SEQ ID NO: 9388 - DNA, 13 bp, Artificial Sequence
  synthetic sequence
ccagatggcatgc

SEQ ID NO: 9389 - DNA, 13 bp, Artificial Sequence
  synthetic sequence
agttatccacggt

SEQ ID NO: 9390 - DNA, 13 bp, Artificial Sequence
  synthetic sequence
gaataggtgaaga

SEQ ID NO: 9391 - DNA, 13 bp, Artificial Sequence
  synthetic sequence
agcttttcttcca

SEQ ID NO: 9392 - DNA, 13 bp, Artificial Sequence
  synthetic sequence
cctggtgtccagc

SEQ ID NO: 9393 - DNA, 13 bp, Artificial Sequence
  synthetic sequence
tctccaccagcag

SEQ ID NO: 9394 - DNA, 13 bp, Artificial Sequence
  synthetic sequence
cttagttcatctt

SEQ ID NO: 9395 - DNA, 13 bp, Artificial Sequence
  synthetic sequence
acgtacttggaga

SEQ ID NO: 9396 - DNA, 13 bp, Artificial Sequence
  synthetic sequence
aatccaattttct

SEQ ID NO: 9397 - DNA, 13 bp, Artificial Sequence
  synthetic sequence
tctcgttcctctt

SEQ ID NO: 9398 - DNA, 13 bp, Artificial Sequence
  synthetic sequence
gcaccatctgggt

SEQ ID NO: 9399 - DNA, 13 bp, Artificial Sequence
  synthetic sequence
gctctagcaatca

SEQ ID NO: 9400 - DNA, 13 bp, Artificial Sequence
  synthetic sequence
tgatcttgatcaa

SEQ ID NO: 9401 - DNA, 13 bp, Artificial Sequence
  synthetic sequence
tctcatttctctt

SEQ ID NO: 9402 - DNA, 13 bp, Artificial Sequence
  synthetic sequence
aatttcctggtgt

SEQ ID NO: 9403 - DNA, 13 bp, Artificial Sequence
  synthetic sequence
tttgaagtaaaca

SEQ ID NO: 9404 - DNA, 13 bp, Artificial Sequence
  synthetic sequence
tgaatttctttca

SEQ ID NO: 9405 - DNA, 13 bp, Artificial Sequence
  synthetic sequence
acttggaaaagat

SEQ ID NO: 9406 - DNA, 13 bp, Artificial Sequence
  synthetic sequence
gccactgccatgg

SEQ ID NO: 9407 - DNA, 13 bp, Artificial Sequence
  synthetic sequence
ccaattttctcta

SEQ ID NO: 9408 - DNA, 13 bp, Artificial Sequence
  synthetic sequence
gccccaagtgact

SEQ ID NO: 9409 - DNA, 13 bp, Artificial Sequence
  synthetic sequence
tttctcttagcca

SEQ ID NO: 9410 - DNA, 13 bp, Artificial Sequence
  synthetic sequence
tcacgtaagggag

SEQ ID NO: 9411 - DNA, 13 bp, Artificial Sequence
  synthetic sequence
ccaactgtttgag

SEQ ID NO: 9412 - DNA, 13 bp, Artificial Sequence
  synthetic sequence
tgcctttttcttc

SEQ ID NO: 9413 - DNA, 13 bp, Artificial Sequence
  synthetic sequence
tggaatgcactag

SEQ ID NO: 9414 - DNA, 13 bp, Artificial Sequence
  synthetic sequence
gcatgggttggca

SEQ ID NO: 9415 - DNA, 13 bp, Artificial Sequence
  synthetic sequence
acaaattccaact

SEQ ID NO: 9416 - DNA, 13 bp, Artificial Sequence
  synthetic sequence
ttctttttcaacc

SEQ ID NO: 9417 - DNA, 13 bp, Artificial Sequence
  synthetic sequence
tatctctcttctt

SEQ ID NO: 9418 - DNA, 13 bp, Artificial Sequence
  synthetic sequence
cgtcaccataggc

SEQ ID NO: 9419 - DNA, 13 bp, Artificial Sequence
  synthetic sequence
agtggaaagcact

SEQ ID NO: 9420 - DNA, 13 bp, Artificial Sequence
  synthetic sequence
gttaatgtttctc

SEQ ID NO: 9421 - DNA, 13 bp, Artificial Sequence
  synthetic sequence
ttggggtacttac

SEQ ID NO: 9422 - DNA, 13 bp, Artificial Sequence
  synthetic sequence
cccttagctgcgt

SEQ ID NO: 9423 - DNA, 13 bp, Artificial Sequence
  synthetic sequence
ggtaggttgattc

SEQ ID NO: 9424 - DNA, 13 bp, Artificial Sequence
  synthetic sequence
acatgagctggcc

SEQ ID NO: 9425 - DNA, 13 bp, Artificial Sequence
  synthetic sequence
tcacagtagtaca

SEQ ID NO: 9426 - DNA, 13 bp, Artificial Sequence
  synthetic sequence
gcattgcttgcag

SEQ ID NO: 9427 - DNA, 13 bp, Artificial Sequence
  synthetic sequence
ttgctccaaaaca

SEQ ID NO: 9428 - DNA, 13 bp, Artificial Sequence
  synthetic sequence
agacacatttgct

SEQ ID NO: 9429 - DNA, 13 bp, Artificial Sequence
  synthetic sequence
gtgaacccactac

SEQ ID NO: 9430 - DNA, 13 bp, Artificial Sequence
  synthetic sequence
gttggtaaaatgg

SEQ ID NO: 9431 - DNA, 13 bp, Artificial Sequence
  synthetic sequence
tgaagtatgatcg

SEQ ID NO: 9432 - DNA, 13 bp, Artificial Sequence
  synthetic sequence
tcatttcttttga

SEQ ID NO: 9433 - DNA, 13 bp, Artificial Sequence
  synthetic sequence
tgtacatcacata

SEQ ID NO: 9434 - DNA, 13 bp, Artificial Sequence
  synthetic sequence
gcatcactggatg

SEQ ID NO: 9435 - DNA, 13 bp, Artificial Sequence
  synthetic sequence
tcatcctttacat

SEQ ID NO: 9436 - DNA, 13 bp, Artificial Sequence
  synthetic sequence
tttcttttggcca

SEQ ID NO: 9437 - DNA, 13 bp, Artificial Sequence
  synthetic sequence
tcatggtggtgat

SEQ ID NO: 9438 - DNA, 13 bp, Artificial Sequence
  synthetic sequence
atccaacaaacaa

SEQ ID NO: 9439 - DNA, 13 bp, Artificial Sequence
  synthetic sequence
attcgatgtagtt

SEQ ID NO: 9440 - DNA, 13 bp, Artificial Sequence
  synthetic sequence
tagtacacccctg

SEQ ID NO: 9441 - DNA, 13 bp, Artificial Sequence
  synthetic sequence
ccattgtgccaag

SEQ ID NO: 9442 - DNA, 13 bp, Artificial Sequence
  synthetic sequence
tccatgtcaaacc

SEQ ID NO: 9443 - DNA, 13 bp, Artificial Sequence
  synthetic sequence
gccaacggcggta

SEQ ID NO: 9444 - DNA, 13 bp, Artificial Sequence
  synthetic sequence
tgggaagttgtac

SEQ ID NO: 9445 - DNA, 13 bp, Artificial Sequence
  synthetic sequence
ggatgtccatgtc

SEQ ID NO: 9446 - DNA, 13 bp, Artificial Sequence
  synthetic sequence
tgagcacccatta

SEQ ID NO: 9447 - DNA, 13 bp, Artificial Sequence
  synthetic sequence
cacgttgttgaat

SEQ ID NO: 9448 - DNA, 13 bp, Artificial Sequence
  synthetic sequence
aatttgctggttg

SEQ ID NO: 9449 - DNA, 13 bp, Artificial Sequence
  synthetic sequence
tcatgtcagctcc

SEQ ID NO: 9450 - DNA, 13 bp, Artificial Sequence
  synthetic sequence
acatacttggaga

SEQ ID NO: 9451 - DNA, 13 bp, Artificial Sequence
  synthetic sequence
ccactgggcagaa

SEQ ID NO: 9452 - DNA, 13 bp, Artificial Sequence
  synthetic sequence
tttctctcattaa

SEQ ID NO: 9453 - DNA, 13 bp, Artificial Sequence
  synthetic sequence
acataagtgacta

SEQ ID NO: 9454 - DNA, 13 bp, Artificial Sequence
  synthetic sequence
tccatgataacca

SEQ ID NO: 9455 - DNA, 13 bp, Artificial Sequence
  synthetic sequence
accggggaaacag

SEQ ID NO: 9456 - DNA, 13 bp, Artificial Sequence
  synthetic sequence
atttgtcagctgg

SEQ ID NO: 9457 - DNA, 13 bp, Artificial Sequence
  synthetic sequence
tccctggcttgtg

SEQ ID NO: 9458 - DNA, 13 bp, Artificial Sequence
  synthetic sequence
gcataatcaaatc

SEQ ID NO: 9459 - DNA, 13 bp, Artificial Sequence
  synthetic sequence
ctgtaaacttctt

SEQ ID NO: 9460 - DNA, 13 bp, Artificial Sequence
  synthetic sequence
gtgaacaaaatgc

SEQ ID NO: 9461 - DNA, 13 bp, Artificial Sequence
  synthetic sequence
actttccggtggc

SEQ ID NO: 9462 - DNA, 13 bp, Artificial Sequence
  synthetic sequence
ttgtacataacat

SEQ ID NO: 9463 - DNA, 13 bp, Artificial Sequence
  synthetic sequence
atggtgatttcca

SEQ ID NO: 9464 - DNA, 13 bp, Artificial Sequence
  synthetic sequence
tgtctctcttttt

SEQ ID NO: 9465 - DNA, 13 bp, Artificial Sequence
  synthetic sequence
gtgtaataattca

SEQ ID NO: 9466 - DNA, 13 bp, Artificial Sequence
  synthetic sequence
gtattgctaatcc

SEQ ID NO: 9467 - DNA, 13 bp, Artificial Sequence
  synthetic sequence
gccatcctcattg

SEQ ID NO: 9468 - DNA, 13 bp, Artificial Sequence
  synthetic sequence
agccattgccatg

SEQ ID NO: 9469 - DNA, 13 bp, Artificial Sequence
  synthetic sequence
actatggtctctc

SEQ ID NO: 9470 - DNA, 13 bp, Artificial Sequence
  synthetic sequence
gtggtggaagctg

SEQ ID NO: 9471 - DNA, 13 bp, Artificial Sequence
  synthetic sequence
ctgtgaatttctt

SEQ ID NO: 9472 - DNA, 13 bp, Artificial Sequence
  synthetic sequence
tctcacccaacat

SEQ ID NO: 9473 - DNA, 13 bp, Artificial Sequence
  synthetic sequence
tcatccattatca

SEQ ID NO: 9474 - DNA, 13 bp, Artificial Sequence
  synthetic sequence
ggggtgttcatga

SEQ ID NO: 9475 - DNA, 13 bp, Artificial Sequence
  synthetic sequence
tgatgttacgttc

SEQ ID NO: 9476 - DNA, 13 bp, Artificial Sequence
  synthetic sequence
caatacggtgttt

SEQ ID NO: 9477 - DNA, 13 bp, Artificial Sequence
  synthetic sequence
gcttcttcaaaat

SEQ ID NO: 9478 - DNA, 13 bp, Artificial Sequence
  synthetic sequence
catctttgacata

SEQ ID NO: 9479 - DNA, 13 bp, Artificial Sequence
  synthetic sequence
atgtttctttcag

SEQ ID NO: 9480 - DNA, 13 bp, Artificial Sequence
  synthetic sequence
gtgttgatgtcca

SEQ ID NO: 9481 - DNA, 13 bp, Artificial Sequence
  synthetic sequence
gcataggacacca

SEQ ID NO: 9482 - DNA, 13 bp, Artificial Sequence
  synthetic sequence
gctatggccctgg

SEQ ID NO: 9483 - DNA, 13 bp, Artificial Sequence
  synthetic sequence
tgtatgcaccttg

SEQ ID NO: 9484 - DNA, 13 bp, Artificial Sequence
  synthetic sequence
tacattatctgat

SEQ ID NO: 9485 - DNA, 13 bp, Artificial Sequence
  synthetic sequence
tgccaggccaata

SEQ ID NO: 9486 - DNA, 13 bp, Artificial Sequence
  synthetic sequence
tgtgtcaggcagg

SEQ ID NO: 9487 - DNA, 13 bp, Artificial Sequence
  synthetic sequence
tgtccctcttctt

SEQ ID NO: 9488 - DNA, 13 bp, Artificial Sequence
  synthetic sequence
tcgtgggctccaa

SEQ ID NO: 9489 - DNA, 13 bp, Artificial Sequence
  synthetic sequence
ttacactgcacgt

SEQ ID NO: 9490 - DNA, 13 bp, Artificial Sequence
  synthetic sequence
cacacactagtgg

SEQ ID NO: 9491 - DNA, 13 bp, Artificial Sequence
  synthetic sequence
gtgtttgggagag

SEQ ID NO: 9492 - DNA, 13 bp, Artificial Sequence
  synthetic sequence
actctgaccttag

SEQ ID NO: 9493 - DNA, 13 bp, Artificial Sequence
  synthetic sequence
atgtaatctactc

SEQ ID NO: 9494 - DNA, 13 bp, Artificial Sequence
  synthetic sequence
aaactccaactta

SEQ ID NO: 9495 - DNA, 13 bp, Artificial Sequence
  synthetic sequence
tcttgtgtggcta

SEQ ID NO: 9496 - DNA, 13 bp, Artificial Sequence
  synthetic sequence
aggcttcaatgtt

SEQ ID NO: 9497 - DNA, 13 bp, Artificial Sequence
  synthetic sequence
gctggatgacatg

SEQ ID NO: 9498 - DNA, 13 bp, Artificial Sequence
  synthetic sequence
gcaccactattct

SEQ ID NO: 9499 - DNA, 13 bp, Artificial Sequence
  synthetic sequence
atgtctagtgaca

SEQ ID NO: 9500 - DNA, 13 bp, Artificial Sequence
  synthetic sequence
ccatcacttgaat

SEQ ID NO: 9501 - DNA, 13 bp, Artificial Sequence
  synthetic sequence
acataattggatg

SEQ ID NO: 9502 - DNA, 13 bp, Artificial Sequence
  synthetic sequence
taatcaaaccctg

SEQ ID NO: 9503 - DNA, 13 bp, Artificial Sequence
  synthetic sequence
cacatctgctctg

SEQ ID NO: 9504 - DNA, 13 bp, Artificial Sequence
  synthetic sequence
aggccattctcat

SEQ ID NO: 9505 - DNA, 13 bp, Artificial Sequence
  synthetic sequence
aatggggccaatg

SEQ ID NO: 9506 - DNA, 13 bp, Artificial Sequence
  synthetic sequence
attcagtgaggca

SEQ ID NO: 9507 - DNA, 13 bp, Artificial Sequence
  synthetic sequence
gcagtgattattc

SEQ ID NO: 9508 - DNA, 13 bp, Artificial Sequence
  synthetic sequence
gacttgtcagctg

SEQ ID NO: 9509 - DNA, 13 bp, Artificial Sequence
  synthetic sequence
aaatcttgcttgc

SEQ ID NO: 9510 - DNA, 13 bp, Artificial Sequence
  synthetic sequence
ccagatggcatac

SEQ ID NO: 9511 - DNA, 13 bp, Artificial Sequence
  synthetic sequence
cgtacggcacgga

SEQ ID NO: 9512 - DNA, 13 bp, Artificial Sequence
  synthetic sequence
ccaactttctggg

SEQ ID NO: 9513 - DNA, 13 bp, Artificial Sequence
  synthetic sequence
cctggtgaggcat

SEQ ID NO: 9514 - DNA, 13 bp, Artificial Sequence
  synthetic sequence
gccttttgttcta

SEQ ID NO: 9515 - DNA, 13 bp, Artificial Sequence
  synthetic sequence
attgcctcttcaa

SEQ ID NO: 9516 - DNA, 13 bp, Artificial Sequence
  synthetic sequence
ggcagaagttccg

SEQ ID NO: 9517 - DNA, 13 bp, Artificial Sequence
  synthetic sequence
ccaagagactgtt

SEQ ID NO: 9518 - DNA, 13 bp, Artificial Sequence
  synthetic sequence
atgttgactatcc

SEQ ID NO: 9519 - DNA, 13 bp, Artificial Sequence
  synthetic sequence
catctgacattat

SEQ ID NO: 9520 - DNA, 13 bp, Artificial Sequence
  synthetic sequence
atgtctcttttct

SEQ ID NO: 9521 - DNA, 13 bp, Artificial Sequence
  synthetic sequence
tctttttgagcca

SEQ ID NO: 9522 - DNA, 13 bp, Artificial Sequence
  synthetic sequence
ctctggttggaaa

SEQ ID NO: 9523 - DNA, 13 bp, Artificial Sequence
  synthetic sequence
cacaattgttggt

SEQ ID NO: 9524 - DNA, 13 bp, Artificial Sequence
  synthetic sequence
tgaaatgcactgg

SEQ ID NO: 9525 - DNA, 13 bp, Artificial Sequence
  synthetic sequence
tcattgatgatca

SEQ ID NO: 9526 - DNA, 13 bp, Artificial Sequence
  synthetic sequence
gccaacggtatta

SEQ ID NO: 9527 - DNA, 13 bp, Artificial Sequence
  synthetic sequence
atctagctgggta

SEQ ID NO: 9528 - DNA, 13 bp, Artificial Sequence
  synthetic sequence
tacgggcaggtga

SEQ ID NO: 9529 - DNA, 13 bp, Artificial Sequence
  synthetic sequence
cggaattgtctac

SEQ ID NO: 9530 - DNA, 13 bp, Artificial Sequence
  synthetic sequence
acgtgcactgtat

SEQ ID NO: 9531 - DNA, 13 bp, Artificial Sequence
  synthetic sequence
gcattgctagccg

SEQ ID NO: 9532 - DNA, 13 bp, Artificial Sequence
  synthetic sequence
tttggttgagagg

SEQ ID NO: 9533 - DNA, 13 bp, Artificial Sequence
  synthetic sequence
tgacatcaaattc

SEQ ID NO: 9534 - DNA, 13 bp, Artificial Sequence
  synthetic sequence
tccacggcaccac

SEQ ID NO: 9535 - DNA, 13 bp, Artificial Sequence
  synthetic sequence
tggaagtgttttc

SEQ ID NO: 9536 - DNA, 13 bp, Artificial Sequence
  synthetic sequence
agtggaaggcact

SEQ ID NO: 9537 - DNA, 13 bp, Artificial Sequence
  synthetic sequence
ttatagtgatttc

SEQ ID NO: 9538 - DNA, 13 bp, Artificial Sequence
  synthetic sequence
acctggctgggta

SEQ ID NO: 9539 - DNA, 13 bp, Artificial Sequence
  synthetic sequence
tctctggatgaca

SEQ ID NO: 9540 - DNA, 13 bp, Artificial Sequence
  synthetic sequence
cccatgtgaaccg

SEQ ID NO: 9541 - DNA, 13 bp, Artificial Sequence
  synthetic sequence
gtgattataccta

SEQ ID NO: 9542 - DNA, 13 bp, Artificial Sequence
  synthetic sequence
aggttctttagca

SEQ ID NO: 9543 - DNA, 13 bp, Artificial Sequence
  synthetic sequence
tcaatgatagcca

SEQ ID NO: 9544 - DNA, 13 bp, Artificial Sequence
  synthetic sequence
tcacaataataca

SEQ ID NO: 9545 - DNA, 13 bp, Artificial Sequence
  synthetic sequence
tgttttccttctc

SEQ ID NO: 9546 - DNA, 13 bp, Artificial Sequence
  synthetic sequence
tcattgatgcact

SEQ ID NO: 9547 - DNA, 13 bp, Artificial Sequence
  synthetic sequence
aacccgtgtgaac

SEQ ID NO: 9548 - DNA, 13 bp, Artificial Sequence
  synthetic sequence
tcatccttcacat

SEQ ID NO: 9549 - DNA, 13 bp, Artificial Sequence
  synthetic sequence
tcttactccaaaa

SEQ ID NO: 9550 - DNA, 13 bp, Artificial Sequence
  synthetic sequence
aacgcgtcgaaga

SEQ ID NO: 9551 - DNA, 13 bp, Artificial Sequence
  synthetic sequence
ggggtgtgagcgt

SEQ ID NO: 9552 - DNA, 13 bp, Artificial Sequence
  synthetic sequence
cataaagcgagtc

SEQ ID NO: 9553 - DNA, 13 bp, Artificial Sequence
  synthetic sequence
cgcgttactagct

SEQ ID NO: 9554 - DNA, 13 bp, Artificial Sequence
  synthetic sequence
tggtatgtctatg

SEQ ID NO: 9555 - DNA, 13 bp, Artificial Sequence
  synthetic sequence
tcgtgagcgccta

SEQ ID NO: 9556 - DNA, 13 bp, Artificial Sequence
  synthetic sequence
ctaccgtaggcaa

SEQ ID NO: 9557 - DNA, 13 bp, Artificial Sequence
  synthetic sequence
tcttcttaagcca

SEQ ID NO: 9558 - DNA, 13 bp, Artificial Sequence
  synthetic sequence
gcgcaggtttatt

SEQ ID NO: 9559 - DNA, 13 bp, Artificial Sequence
  synthetic sequence
tgtctctggcttg

SEQ ID NO: 9560 - DNA, 13 bp, Artificial Sequence
  synthetic sequence
tttctcttggcca

SEQ ID NO: 9561 - DNA, 13 bp, Artificial Sequence
  synthetic sequence
gagaagagataat

SEQ ID NO: 9562 - DNA, 13 bp, Artificial Sequence
  synthetic sequence
tggtagtggtgtt

SEQ ID NO: 9563 - DNA, 13 bp, Artificial Sequence
  synthetic sequence
tggaaagcacttg

SEQ ID NO: 9564 - DNA, 13 bp, Artificial Sequence
  synthetic sequence
tcatgtctgcccc

SEQ ID NO: 9565 - DNA, 13 bp, Artificial Sequence
  synthetic sequence
ttatacatgacat

SEQ ID NO: 9566 - DNA, 13 bp, Artificial Sequence
  synthetic sequence
tatccatgtcaaa

SEQ ID NO: 9567 - DNA, 13 bp, Artificial Sequence
  synthetic sequence
cagtgtctagtgt

SEQ ID NO: 9568 - DNA, 13 bp, Artificial Sequence
  synthetic sequence
atgtttggggagt

SEQ ID NO: 9569 - DNA, 13 bp, Artificial Sequence
  synthetic sequence
ttgactgaatgga

SEQ ID NO: 9570 - DNA, 13 bp, Artificial Sequence
  synthetic sequence
actccaatttgtc

SEQ ID NO: 9571 - DNA, 13 bp, Artificial Sequence
  synthetic sequence
gcatcgaagattc

SEQ ID NO: 9572 - DNA, 13 bp, Artificial Sequence
  synthetic sequence
caatccaattcga

SEQ ID NO: 9573 - DNA, 13 bp, Artificial Sequence
  synthetic sequence
gttaatgttcctt

SEQ ID NO: 9574 - DNA, 13 bp, Artificial Sequence
  synthetic sequence
agcatggtgtgtg

SEQ ID NO: 9575 - DNA, 13 bp, Artificial Sequence
  synthetic sequence
gaaaggcactggg

SEQ ID NO: 9576 - DNA, 13 bp, Artificial Sequence
  synthetic sequence
agcatcttttaaa

SEQ ID NO: 9577 - DNA, 13 bp, Artificial Sequence
  synthetic sequence
tctccaaattggt

SEQ ID NO: 9578 - DNA, 13 bp, Artificial Sequence
  synthetic sequence
actggtagtcctt

SEQ ID NO: 9579 - DNA, 13 bp, Artificial Sequence
  synthetic sequence
gtggtgtctcgca

SEQ ID NO: 9580 - DNA, 13 bp, Artificial Sequence
  synthetic sequence
acattgttgaaca

SEQ ID NO: 9581 - DNA, 13 bp, Artificial Sequence
  synthetic sequence
gcgtgggttggta

SEQ ID NO: 9582 - DNA, 13 bp, Artificial Sequence
  synthetic sequence
ttgctccaaaata

SEQ ID NO: 9583 - DNA, 13 bp, Artificial Sequence
  synthetic sequence
cgtaattagatgt

SEQ ID NO: 9584 - DNA, 13 bp, Artificial Sequence
  synthetic sequence
gtgagtccatagt

SEQ ID NO: 9585 - DNA, 13 bp, Artificial Sequence
  synthetic sequence
gtgcacctggtgg

SEQ ID NO: 9586 - DNA, 13 bp, Artificial Sequence
  synthetic sequence
cgtcgttggacta

SEQ ID NO: 9587 - DNA, 13 bp, Artificial Sequence
  synthetic sequence
aggtaagctatcc

SEQ ID NO: 9588 - DNA, 13 bp, Artificial Sequence
  synthetic sequence
atttcaactgatg

SEQ ID NO: 9589 - DNA, 13 bp, Artificial Sequence
  synthetic sequence
atgtgaaaaattc

SEQ ID NO: 9590 - DNA, 13 bp, Artificial Sequence
  synthetic sequence
acatttggtgaat

SEQ ID NO: 9591 - DNA, 13 bp, Artificial Sequence
  synthetic sequence
ggtaggacaatag

SEQ ID NO: 9592 - DNA, 13 bp, Artificial Sequence
  synthetic sequence
actcttaggggtg

SEQ ID NO: 9593 - DNA, 13 bp, Artificial Sequence
  synthetic sequence
cctttgcttgtca

SEQ ID NO: 9594 - DNA, 13 bp, Artificial Sequence
  synthetic sequence
ttggacgccgcat

SEQ ID NO: 9595 - DNA, 13 bp, Artificial Sequence
  synthetic sequence
caatgtagttgga

SEQ ID NO: 9596 - DNA, 13 bp, Artificial Sequence
  synthetic sequence
atggcgctgtaca

SEQ ID NO: 9597 - DNA, 13 bp, Artificial Sequence
  synthetic sequence
taaactcaggcca

SEQ ID NO: 9598 - DNA, 13 bp, Artificial Sequence
  synthetic sequence
cagcattacatgc

SEQ ID NO: 9599 - DNA, 13 bp, Artificial Sequence
  synthetic sequence
gctacataggggt

SEQ ID NO: 9600 - DNA, 13 bp, Artificial Sequence
  synthetic sequence
tggctaaccccac

SEQ ID NO: 9601 - DNA, 13 bp, Artificial Sequence
  synthetic sequence
aatttgaagtgaa

SEQ ID NO: 9602 - DNA, 13 bp, Artificial Sequence
  synthetic sequence
ttcttgcgttgac

SEQ ID NO: 9603 - DNA, 13 bp, Artificial Sequence
  synthetic sequence
gatcatggtagtg

SEQ ID NO: 9604 - DNA, 13 bp, Artificial Sequence
  synthetic sequence
ttcctttctgttt

SEQ ID NO: 9605 - DNA, 13 bp, Artificial Sequence
  synthetic sequence
aggccaacacgta

SEQ ID NO: 9606 - DNA, 13 bp, Artificial Sequence
  synthetic sequence
tagtaatcatttg

SEQ ID NO: 9607 - DNA, 13 bp, Artificial Sequence
  synthetic sequence
gttgggaaattat

SEQ ID NO: 9608 - DNA, 13 bp, Artificial Sequence
  synthetic sequence
cattgcatgcttc

SEQ ID NO: 9609 - DNA, 13 bp, Artificial Sequence
  synthetic sequence
tccaaggcaccac

SEQ ID NO: 9610 - DNA, 13 bp, Artificial Sequence
  synthetic sequence
ctctatcgctata

SEQ ID NO: 9611 - DNA, 13 bp, Artificial Sequence
  synthetic sequence
agcatatgggatt

SEQ ID NO: 9612 - DNA, 13 bp, Artificial Sequence
  synthetic sequence
gacatgagttgtc

SEQ ID NO: 9613 - DNA, 13 bp, Artificial Sequence
  synthetic sequence
taagcacatttgt

SEQ ID NO: 9614 - DNA, 13 bp, Artificial Sequence
  synthetic sequence
aatagaatttcct

SEQ ID NO: 9615 - DNA, 13 bp, Artificial Sequence
  synthetic sequence
gtcctgcaaagag

SEQ ID NO: 9616 - DNA, 13 bp, Artificial Sequence
  synthetic sequence
tgtgggtgcccct

SEQ ID NO: 9617 - DNA, 13 bp, Artificial Sequence
  synthetic sequence
cacacaccaaggg

SEQ ID NO: 9618 - DNA, 13 bp, Artificial Sequence
  synthetic sequence
cacagtaatacac

SEQ ID NO: 9619 - DNA, 13 bp, Artificial Sequence
  synthetic sequence
ttgatgtcaattt

SEQ ID NO: 9620 - DNA, 13 bp, Artificial Sequence
  synthetic sequence
ttttgcaagtctt

SEQ ID NO: 9621 - DNA, 13 bp, Artificial Sequence
  synthetic sequence
gtctcacctggtg

SEQ ID NO: 9622 - DNA, 13 bp, Artificial Sequence
  synthetic sequence
ctagttggaaagt

SEQ ID NO: 9623 - DNA, 13 bp, Artificial Sequence
  synthetic sequence
cttaatcaagttc

SEQ ID NO: 9624 - DNA, 13 bp, Artificial Sequence
  synthetic sequence
ccacttccaaatg

SEQ ID NO: 9625 - DNA, 13 bp, Artificial Sequence
  synthetic sequence
aaacagttgtata

SEQ ID NO: 9626 - DNA, 13 bp, Artificial Sequence
  synthetic sequence
ggggtgttcataa

SEQ ID NO: 9627 - DNA, 13 bp, Artificial Sequence
  synthetic sequence
tgtccatatcaaa

SEQ ID NO: 9628 - DNA, 13 bp, Artificial Sequence
  synthetic sequence
actttgtgaacat

SEQ ID NO: 9629 - DNA, 13 bp, Artificial Sequence
  synthetic sequence
tggtttgatagaa

SEQ ID NO: 9630 - DNA, 13 bp, Artificial Sequence
  synthetic sequence
cctctccaccagc

SEQ ID NO: 9631 - DNA, 13 bp, Artificial Sequence
  synthetic sequence
cagactctgacat

SEQ ID NO: 9632 - DNA, 13 bp, Artificial Sequence
  synthetic sequence
ctcccccagctgt

SEQ ID NO: 9633 - DNA, 13 bp, Artificial Sequence
  synthetic sequence
tagtatgtgacaa

SEQ ID NO: 9634 - DNA, 13 bp, Artificial Sequence
  synthetic sequence
atgtgtgattgat

SEQ ID NO: 9635 - DNA, 13 bp, Artificial Sequence
  synthetic sequence
tcgttgatgcact

SEQ ID NO: 9636 - DNA, 13 bp, Artificial Sequence
  synthetic sequence
ttcctctctgttt

SEQ ID NO: 9637 - DNA, 13 bp, Artificial Sequence
  synthetic sequence
ggttagtggcgtt

SEQ ID NO: 9638 - DNA, 13 bp, Artificial Sequence
  synthetic sequence
gtagttttgatgt

SEQ ID NO: 9639 - DNA, 13 bp, Artificial Sequence
  synthetic sequence
tccatagtgttct

SEQ ID NO: 9640 - DNA, 13 bp, Artificial Sequence
  synthetic sequence
ggtaatccttggg

SEQ ID NO: 9641 - DNA, 13 bp, Artificial Sequence
  synthetic sequence
ctctcagtctgga

SEQ ID NO: 9642 - DNA, 13 bp, Artificial Sequence
  synthetic sequence
gtggagcgaatcc

SEQ ID NO: 9643 - DNA, 13 bp, Artificial Sequence
  synthetic sequence
tgtgctagcgctt

SEQ ID NO: 9644 - DNA, 13 bp, Artificial Sequence
  synthetic sequence
tgaaatgcacttg

SEQ ID NO: 9645 - DNA, 13 bp, Artificial Sequence
  synthetic sequence
caccatagaggga

SEQ ID NO: 9646 - DNA, 13 bp, Artificial Sequence
  synthetic sequence
atatggtactgaa

SEQ ID NO: 9647 - DNA, 13 bp, Artificial Sequence
  synthetic sequence
cacatcaaattca

SEQ ID NO: 9648 - DNA, 13 bp, Artificial Sequence
  synthetic sequence
aacgccattctca

SEQ ID NO: 9649 - DNA, 13 bp, Artificial Sequence
  synthetic sequence
tccaattgtttga

SEQ ID NO: 9650 - DNA, 13 bp, Artificial Sequence
  synthetic sequence
actctatcaccaa

SEQ ID NO: 9651 - DNA, 13 bp, Artificial Sequence
  synthetic sequence
gcgttgctagctg

SEQ ID NO: 9652 - DNA, 13 bp, Artificial Sequence
  synthetic sequence
gtggaagtgttct

SEQ ID NO: 9653 - DNA, 13 bp, Artificial Sequence
  synthetic sequence
tgtcccttttctt

SEQ ID NO: 9654 - DNA, 13 bp, Artificial Sequence
  synthetic sequence
caagaaccatttt

SEQ ID NO: 9655 - DNA, 13 bp, Artificial Sequence
  synthetic sequence
ggtactaccatag

SEQ ID NO: 9656 - DNA, 13 bp, Artificial Sequence
  synthetic sequence
tccatatcaaatc

SEQ ID NO: 9657 - DNA, 13 bp, Artificial Sequence
  synthetic sequence
ttcaaatcatcca

SEQ ID NO: 9658 - DNA, 13 bp, Artificial Sequence
  synthetic sequence
ttttactccaaaa

SEQ ID NO: 9659 - DNA, 13 bp, Artificial Sequence
  synthetic sequence
agcaccatcttta

SEQ ID NO: 9660 - DNA, 13 bp, Artificial Sequence
  synthetic sequence
atacggtaccgag

SEQ ID NO: 9661 - DNA, 13 bp, Artificial Sequence
  synthetic sequence
cattgataatcat

SEQ ID NO: 9662 - DNA, 13 bp, Artificial Sequence
  synthetic sequence
tgtctagcgacat

SEQ ID NO: 9663 - DNA, 13 bp, Artificial Sequence
  synthetic sequence
ctatccccggcca

SEQ ID NO: 9664 - DNA, 13 bp, Artificial Sequence
  synthetic sequence
tgtctctcttctt

SEQ ID NO: 9665 - DNA, 13 bp, Artificial Sequence
  synthetic sequence
attgtttcacctg

SEQ ID NO: 9666 - DNA, 13 bp, Artificial Sequence
  synthetic sequence
tgcactgcacgtg

SEQ ID NO: 9667 - DNA, 13 bp, Artificial Sequence
  synthetic sequence
tctcattcctctt

SEQ ID NO: 9668 - DNA, 13 bp, Artificial Sequence
  synthetic sequence
tctaattgcttta

SEQ ID NO: 9669 - DNA, 13 bp, Artificial Sequence
  synthetic sequence
cattgatacactc

SEQ ID NO: 9670 - DNA, 13 bp, Artificial Sequence
  synthetic sequence
ctgttcctctcat

SEQ ID NO: 9671 - DNA, 13 bp, Artificial Sequence
  synthetic sequence
agtcgaggcaggg

SEQ ID NO: 9672 - DNA, 13 bp, Artificial Sequence
  synthetic sequence
aaaagcactgggt

SEQ ID NO: 9673 - DNA, 13 bp, Artificial Sequence
  synthetic sequence
ttaaccattgcca

SEQ ID NO: 9674 - DNA, 13 bp, Artificial Sequence
  synthetic sequence
cacccttttgact

SEQ ID NO: 9675 - DNA, 13 bp, Artificial Sequence
  synthetic sequence
agttgtccacggt

SEQ ID NO: 9676 - DNA, 13 bp, Artificial Sequence
  synthetic sequence
ccaccgcccatat

SEQ ID NO: 9677 - DNA, 13 bp, Artificial Sequence
  synthetic sequence
atttagggatgct

SEQ ID NO: 9678 - DNA, 13 bp, Artificial Sequence
  synthetic sequence
tgttttctttctc

SEQ ID NO: 9679 - DNA, 13 bp, Artificial Sequence
  synthetic sequence
tcactatggtgtc

SEQ ID NO: 9680 - DNA, 13 bp, Artificial Sequence
  synthetic sequence
ctgggctcggtgt

SEQ ID NO: 9681 - DNA, 13 bp, Artificial Sequence
  synthetic sequence
tcaatatagttgg

SEQ ID NO: 9682 - DNA, 13 bp, Artificial Sequence
  synthetic sequence
gtcacaaattcga

SEQ ID NO: 9683 - DNA, 13 bp, Artificial Sequence
  synthetic sequence
tggttgggaaatt

SEQ ID NO: 9684 - DNA, 13 bp, Artificial Sequence
  synthetic sequence
ctaatgtgtgttg

SEQ ID NO: 9685 - DNA, 13 bp, Artificial Sequence
  synthetic sequence
tccagtttggttt

SEQ ID NO: 9686 - DNA, 13 bp, Artificial Sequence
  synthetic sequence
tgagccactgcca

SEQ ID NO: 9687 - DNA, 13 bp, Artificial Sequence
  synthetic sequence
cataagcaatcat

SEQ ID NO: 9688 - DNA, 13 bp, Artificial Sequence
  synthetic sequence
ttttcagctatag

SEQ ID NO: 9689 - DNA, 13 bp, Artificial Sequence
  synthetic sequence
caatggaaagaat

SEQ ID NO: 9690 - DNA, 13 bp, Artificial Sequence
  synthetic sequence
ttggggtacttgc

SEQ ID NO: 9691 - DNA, 13 bp, Artificial Sequence
  synthetic sequence
aggtttttcaaca

SEQ ID NO: 9692 - DNA, 13 bp, Artificial Sequence
  synthetic sequence
gggatgattcact

SEQ ID NO: 9693 - DNA, 13 bp, Artificial Sequence
  synthetic sequence
gcttcctcaaagt

SEQ ID NO: 9694 - DNA, 13 bp, Artificial Sequence
  synthetic sequence
gctaagacatagt

SEQ ID NO: 9695 - DNA, 13 bp, Artificial Sequence
  synthetic sequence
tgtgaacaagatg

SEQ ID NO: 9696 - DNA, 13 bp, Artificial Sequence
  synthetic sequence
tctgttcaatatg

SEQ ID NO: 9697 - DNA, 13 bp, Artificial Sequence
  synthetic sequence
tgagttcatcctt

SEQ ID NO: 9698 - DNA, 13 bp, Artificial Sequence
  synthetic sequence
atacactctgatt

SEQ ID NO: 9699 - DNA, 13 bp, Artificial Sequence
  synthetic sequence
ctatggctctagc

SEQ ID NO: 9700 - DNA, 13 bp, Artificial Sequence
  synthetic sequence
tgttgtatgacgt

SEQ ID NO: 9701 - DNA, 13 bp, Artificial Sequence
  synthetic sequence
tgctggctgatga

SEQ ID NO: 9702 - DNA, 13 bp, Artificial Sequence
  synthetic sequence
ccttgacatatgt

SEQ ID NO: 9703 - DNA, 13 bp, Artificial Sequence
  synthetic sequence
tcacaatagtaca

SEQ ID NO: 9704 - DNA, 13 bp, Artificial Sequence
  synthetic sequence
aatctaccctatc

SEQ ID NO: 9705 - DNA, 13 bp, Artificial Sequence
  synthetic sequence
tatctcttttctt

SEQ ID NO: 9706 - DNA, 13 bp, Artificial Sequence
  synthetic sequence
tgcacctggcaat

SEQ ID NO: 9707 - DNA, 13 bp, Artificial Sequence
  synthetic sequence
gtttgtacattac

SEQ ID NO: 9708 - DNA, 13 bp, Artificial Sequence
  synthetic sequence
ctcacattgttaa

SEQ ID NO: 9709 - DNA, 13 bp, Artificial Sequence
  synthetic sequence
aatgcgaatctcc

SEQ ID NO: 9710 - DNA, 13 bp, Artificial Sequence
  synthetic sequence
ccgaattgtccac

SEQ ID NO: 9711 - DNA, 13 bp, Artificial Sequence
  synthetic sequence
tgctccagaacaa

SEQ ID NO: 9712 - DNA, 13 bp, Artificial Sequence
  synthetic sequence
gcacaattattgg

SEQ ID NO: 9713 - DNA, 13 bp, Artificial Sequence
  synthetic sequence
taacagtttacca

SEQ ID NO: 9714 - DNA, 13 bp, Artificial Sequence
  synthetic sequence
gccaataggcaca

SEQ ID NO: 9715 - DNA, 13 bp, Artificial Sequence
  synthetic sequence
gccactaaacctt

SEQ ID NO: 9716 - DNA, 13 bp, Artificial Sequence
  synthetic sequence
cgtaggtgaccaa

SEQ ID NO: 9717 - DNA, 13 bp, Artificial Sequence
  synthetic sequence
tgaaatgcactag

SEQ ID NO: 9718 - DNA, 13 bp, Artificial Sequence
  synthetic sequence
gtacatgacgtac

SEQ ID NO: 9719 - DNA, 13 bp, Artificial Sequence
  synthetic sequence
actgcgtagtcaa

SEQ ID NO: 9720 - DNA, 13 bp, Artificial Sequence
  synthetic sequence
atcctggcccttg

SEQ ID NO: 9721 - DNA, 13 bp, Artificial Sequence
  synthetic sequence
agccattgccagg

SEQ ID NO: 9722 - DNA, 13 bp, Artificial Sequence
  synthetic sequence
tttagatcatcca

SEQ ID NO: 9723 - DNA, 13 bp, Artificial Sequence
  synthetic sequence
aatcccttttctg

SEQ ID NO: 9724 - DNA, 13 bp, Artificial Sequence
  synthetic sequence
acgtaatttgacg

SEQ ID NO: 9725 - DNA, 13 bp, Artificial Sequence
  synthetic sequence
tcgccgcaccgta

SEQ ID NO: 9726 - DNA, 13 bp, Artificial Sequence
  synthetic sequence
aatttaaaggggc

SEQ ID NO: 9727 - DNA, 13 bp, Artificial Sequence
  synthetic sequence
cctggtgaggcgt

SEQ ID NO: 9728 - DNA, 13 bp, Artificial Sequence
  synthetic sequence
tatacactcggga

SEQ ID NO: 9729 - DNA, 13 bp, Artificial Sequence
  synthetic sequence
agttatccacagt

SEQ ID NO: 9730 - DNA, 13 bp, Artificial Sequence
  synthetic sequence
tttctgtgatgag

SEQ ID NO: 9731 - DNA, 13 bp, Artificial Sequence
  synthetic sequence
caacgggacaaca

SEQ ID NO: 9732 - DNA, 13 bp, Artificial Sequence
  synthetic sequence
gtgacattaattg

SEQ ID NO: 9733 - DNA, 13 bp, Artificial Sequence
  synthetic sequence
cgataccgacgta

SEQ ID NO: 9734 - DNA, 13 bp, Artificial Sequence
  synthetic sequence
aacagacaggtag

SEQ ID NO: 9735 - DNA, 13 bp, Artificial Sequence
  synthetic sequence
caacacctcttaa

SEQ ID NO: 9736 - DNA, 13 bp, Artificial Sequence
  synthetic sequence
ctctgatgtgttt

SEQ ID NO: 9737 - DNA, 13 bp, Artificial Sequence
  synthetic sequence
gaattaatgtagt

SEQ ID NO: 9738 - DNA, 13 bp, Artificial Sequence
  synthetic sequence
cgtaggggtatcc

SEQ ID NO: 9739 - DNA, 13 bp, Artificial Sequence
  synthetic sequence
ttctccaacacca

SEQ ID NO: 9740 - DNA, 13 bp, Artificial Sequence
  synthetic sequence
gtaaatccaatga

SEQ ID NO: 9741 - DNA, 13 bp, Artificial Sequence
  synthetic sequence
gaaaatggcttcc

SEQ ID NO: 9742 - DNA, 13 bp, Artificial Sequence
  synthetic sequence
atggccactgaat

SEQ ID NO: 9743 - DNA, 13 bp, Artificial Sequence
  synthetic sequence
gcctggtggtaca

SEQ ID NO: 9744 - DNA, 13 bp, Artificial Sequence
  synthetic sequence
tgcttcggcttca

SEQ ID NO: 9745 - DNA, 13 bp, Artificial Sequence
  synthetic sequence
atgaatttccttc

SEQ ID NO: 9746 - DNA, 13 bp, Artificial Sequence
  synthetic sequence
aatctccttcatt

SEQ ID NO: 9747 - DNA, 13 bp, Artificial Sequence
  synthetic sequence
cgcctcaatgttc

SEQ ID NO: 9748 - DNA, 13 bp, Artificial Sequence
  synthetic sequence
tgcacggtgtaac

SEQ ID NO: 9749 - DNA, 13 bp, Artificial Sequence
  synthetic sequence
tttgctccagaat

SEQ ID NO: 9750 - DNA, 13 bp, Artificial Sequence
  synthetic sequence
tttcgtgagctcc

SEQ ID NO: 9751 - DNA, 13 bp, Artificial Sequence
  synthetic sequence
acggtgaaacatc

SEQ ID NO: 9752 - DNA, 13 bp, Artificial Sequence
  synthetic sequence
ggcgatgtctggt

SEQ ID NO: 9753 - DNA, 13 bp, Artificial Sequence
  synthetic sequence
accaaatttttga

SEQ ID NO: 9754 - DNA, 13 bp, Artificial Sequence
  synthetic sequence
agtttggttttgg

SEQ ID NO: 9755 - DNA, 13 bp, Artificial Sequence
  synthetic sequence
ttacagcattttg

SEQ ID NO: 9756 - DNA, 13 bp, Artificial Sequence
  synthetic sequence
gaagtaaagctaa

SEQ ID NO: 9757 - DNA, 13 bp, Artificial Sequence
  synthetic sequence
gccaagtggtagt

SEQ ID NO: 9758 - DNA, 13 bp, Artificial Sequence
  synthetic sequence
agcgtcccatcct

SEQ ID NO: 9759 - DNA, 13 bp, Artificial Sequence
  synthetic sequence
ttcttcaacaatt

SEQ ID NO: 9760 - DNA, 13 bp, Artificial Sequence
  synthetic sequence
aatccgggctgga

SEQ ID NO: 9761 - DNA, 13 bp, Artificial Sequence
  synthetic sequence
cacatctgttctg

SEQ ID NO: 9762 - DNA, 13 bp, Artificial Sequence
  synthetic sequence
gagaaaatggcct

SEQ ID NO: 9763 - DNA, 13 bp, Artificial Sequence
  synthetic sequence
atatgggactggt

SEQ ID NO: 9764 - DNA, 13 bp, Artificial Sequence
  synthetic sequence
cgttacatgcctc

SEQ ID NO: 9765 - DNA, 13 bp, Artificial Sequence
  synthetic sequence
tgttcctctcagt

SEQ ID NO: 9766 - DNA, 13 bp, Artificial Sequence
  synthetic sequence
aatctcctggtgt

SEQ ID NO: 9767 - DNA, 13 bp, Artificial Sequence
  synthetic sequence
tccaccctgtcac

SEQ ID NO: 9768 - DNA, 13 bp, Artificial Sequence
  synthetic sequence
ttgtccctggcct

SEQ ID NO: 9769 - DNA, 13 bp, Artificial Sequence
  synthetic sequence
agagggcagcatc

SEQ ID NO: 9770 - DNA, 13 bp, Artificial Sequence
  synthetic sequence
gtgaagcgtgggt

SEQ ID NO: 9771 - DNA, 13 bp, Artificial Sequence
  synthetic sequence
atacatgatctga

SEQ ID NO: 9772 - DNA, 13 bp, Artificial Sequence
  synthetic sequence
aagtctagtggtg

SEQ ID NO: 9773 - DNA, 13 bp, Artificial Sequence
  synthetic sequence
tgctctagcaatt

SEQ ID NO: 9774 - DNA, 13 bp, Artificial Sequence
  synthetic sequence
tgtgcaaagtctt

SEQ ID NO: 9775 - DNA, 13 bp, Artificial Sequence
  synthetic sequence
atgcgcttggttc

SEQ ID NO: 9776 - DNA, 13 bp, Artificial Sequence
  synthetic sequence
cctgacgtgtttg

SEQ ID NO: 9777 - DNA, 13 bp, Artificial Sequence
  synthetic sequence
tttgcacttgact

SEQ ID NO: 9778 - DNA, 13 bp, Artificial Sequence
  synthetic sequence
aacgagtcacctt

SEQ ID NO: 9779 - DNA, 13 bp, Artificial Sequence
  synthetic sequence
agcttgtctcttg

SEQ ID NO: 9780 - DNA, 13 bp, Artificial Sequence
  synthetic sequence
atggcaacataag

SEQ ID NO: 9781 - DNA, 13 bp, Artificial Sequence
  synthetic sequence
cttgatgtctatt

SEQ ID NO: 9782 - DNA, 13 bp, Artificial Sequence
  synthetic sequence
tggacgagatact

SEQ ID NO: 9783 - DNA, 13 bp, Artificial Sequence
  synthetic sequence
gtcgtccatgatg

SEQ ID NO: 9784 - DNA, 13 bp, Artificial Sequence
  synthetic sequence
aacccgattttct

SEQ ID NO: 9785 - DNA, 13 bp, Artificial Sequence
  synthetic sequence
taatgaggttttt

SEQ ID NO: 9786 - DNA, 13 bp, Artificial Sequence
  synthetic sequence
gaatccaacactc

SEQ ID NO: 9787 - DNA, 13 bp, Artificial Sequence
  synthetic sequence
gatggagcattga

SEQ ID NO: 9788 - DNA, 13 bp, Artificial Sequence
  synthetic sequence
ggcaacccttgag

SEQ ID NO: 9789 - DNA, 13 bp, Artificial Sequence
  synthetic sequence
gtcctcttgtgta

SEQ ID NO: 9790 - DNA, 13 bp, Artificial Sequence
  synthetic sequence
gtagatcttctgt

SEQ ID NO: 9791 - DNA, 13 bp, Artificial Sequence
  synthetic sequence
agttgctttaatt

SEQ ID NO: 9792 - DNA, 13 bp, Artificial Sequence
  synthetic sequence
cacacaccagggg

SEQ ID NO: 9793 - DNA, 13 bp, Artificial Sequence
  synthetic sequence
ccttcaccaccgg

SEQ ID NO: 9794 - DNA, 13 bp, Artificial Sequence
  synthetic sequence
ggatgtccatatc

SEQ ID NO: 9795 - DNA, 13 bp, Artificial Sequence
  synthetic sequence
caccattgtgcca

SEQ ID NO: 9796 - DNA, 13 bp, Artificial Sequence
  synthetic sequence
tttctgataatgg

SEQ ID NO: 9797 - DNA, 13 bp, Artificial Sequence
  synthetic sequence
gtagaatggccac

SEQ ID NO: 9798 - DNA, 13 bp, Artificial Sequence
  synthetic sequence
tgagttcatcttt

SEQ ID NO: 9799 - DNA, 13 bp, Artificial Sequence
  synthetic sequence
gacatcaattgtc

SEQ ID NO: 9800 - DNA, 13 bp, Artificial Sequence
  synthetic sequence
agtgtaccatcct

SEQ ID NO: 9801 - DNA, 13 bp, Artificial Sequence
  synthetic sequence
atgttaacaatcc

SEQ ID NO: 9802 - DNA, 13 bp, Artificial Sequence
  synthetic sequence
gtgaacttcttca

SEQ ID NO: 9803 - DNA, 13 bp, Artificial Sequence
  synthetic sequence
gaatggataacca

SEQ ID NO: 9804 - DNA, 13 bp, Artificial Sequence
  synthetic sequence
gtctcacccggtg

SEQ ID NO: 9805 - DNA, 13 bp, Artificial Sequence
  synthetic sequence
cagatttgtcggc

SEQ ID NO: 9806 - DNA, 13 bp, Artificial Sequence
  synthetic sequence
atgttagatctcc

SEQ ID NO: 9807 - DNA, 13 bp, Artificial Sequence
  synthetic sequence
gtctggtaaaaca

SEQ ID NO: 9808 - DNA, 13 bp, Artificial Sequence
  synthetic sequence
tcaaggttggttc

SEQ ID NO: 9809 - DNA, 13 bp, Artificial Sequence
  synthetic sequence
acaattgttagtg

SEQ ID NO: 9810 - DNA, 13 bp, Artificial Sequence
  synthetic sequence
gagatgagatgat

SEQ ID NO: 9811 - DNA, 13 bp, Artificial Sequence
  synthetic sequence
ccaccaccatcct

SEQ ID NO: 9812 - DNA, 13 bp, Artificial Sequence
  synthetic sequence
aagcgcctagcta

SEQ ID NO: 9813 - DNA, 13 bp, Artificial Sequence
  synthetic sequence
tcactgcgttttg

SEQ ID NO: 9814 - DNA, 13 bp, Artificial Sequence
  synthetic sequence
agctgcacctggc

SEQ ID NO: 9815 - DNA, 13 bp, Artificial Sequence
  synthetic sequence
attacaggtagcc

SEQ ID NO: 9816 - DNA, 13 bp, Artificial Sequence
  synthetic sequence
agtaatgctagtg

SEQ ID NO: 9817 - DNA, 13 bp, Artificial Sequence
  synthetic sequence
agtccaaatctcg

SEQ ID NO: 9818 - DNA, 13 bp, Artificial Sequence
  synthetic sequence
ataatgaagaaaa

SEQ ID NO: 9819 - DNA, 13 bp, Artificial Sequence
  synthetic sequence
aatgcctttggag

SEQ ID NO: 9820 - DNA, 13 bp, Artificial Sequence
  synthetic sequence
ttagatggactaa

SEQ ID NO: 9821 - DNA, 13 bp, Artificial Sequence
  synthetic sequence
tgcaaaatccaga

SEQ ID NO: 9822 - DNA, 13 bp, Artificial Sequence
  synthetic sequence
ttgcaaatgcaaa

SEQ ID NO: 9823 - DNA, 13 bp, Artificial Sequence
  synthetic sequence
caccatggagcta

SEQ ID NO: 9824 - DNA, 13 bp, Artificial Sequence
  synthetic sequence
agaatagtgaatg

SEQ ID NO: 9825 - DNA, 13 bp, Artificial Sequence
  synthetic sequence
ccaacaagagctg

SEQ ID NO: 9826 - DNA, 13 bp, Artificial Sequence
  synthetic sequence
tggacattgaagt

SEQ ID NO: 9827 - DNA, 13 bp, Artificial Sequence
  synthetic sequence
atacacaaggtga

SEQ ID NO: 9828 - DNA, 13 bp, Artificial Sequence
  synthetic sequence
aagtttttgaagg

SEQ ID NO: 9829 - DNA, 13 bp, Artificial Sequence
  synthetic sequence
ggagaaatctttg

SEQ ID NO: 9830 - DNA, 13 bp, Artificial Sequence
  synthetic sequence
gggggtggaattg

SEQ ID NO: 9831 - DNA, 13 bp, Artificial Sequence
  synthetic sequence
gtccatacacagg

SEQ ID NO: 9832 - DNA, 13 bp, Artificial Sequence
  synthetic sequence
tgttaatggatga

SEQ ID NO: 9833 - DNA, 13 bp, Artificial Sequence
  synthetic sequence
aaaccatgcctca

SEQ ID NO: 9834 - DNA, 13 bp, Artificial Sequence
  synthetic sequence
gattggcaatcag

SEQ ID NO: 9835 - DNA, 13 bp, Artificial Sequence
  synthetic sequence
ttaactcagcata

SEQ ID NO: 9836 - DNA, 13 bp, Artificial Sequence
  synthetic sequence
aatcatatcagca

SEQ ID NO: 9837 - DNA, 13 bp, Artificial Sequence
  synthetic sequence
atagattatttgt

SEQ ID NO: 9838 - DNA, 13 bp, Artificial Sequence
  synthetic sequence
gaaaaatcagaag

SEQ ID NO: 9839 - DNA, 13 bp, Artificial Sequence
  synthetic sequence
cacgcatctgttg

SEQ ID NO: 9840 - DNA, 13 bp, Artificial Sequence
  synthetic sequence
taaatgaccttct

SEQ ID NO: 9841 - DNA, 13 bp, Artificial Sequence
  synthetic sequence
atcccatacccct

SEQ ID NO: 9842 - DNA, 13 bp, Artificial Sequence
  synthetic sequence
acagaagttaccc

SEQ ID NO: 9843 - DNA, 13 bp, Artificial Sequence
  synthetic sequence
catttttaatagc

SEQ ID NO: 9844 - DNA, 13 bp, Artificial Sequence
  synthetic sequence
ccaggtacagcaa

SEQ ID NO: 9845 - DNA, 13 bp, Artificial Sequence
  synthetic sequence
cagcagacaaagg

SEQ ID NO: 9846 - DNA, 13 bp, Artificial Sequence
  synthetic sequence
cacccatcaaatg

SEQ ID NO: 9847 - DNA, 13 bp, Artificial Sequence
  synthetic sequence
acactatgatcaa

SEQ ID NO: 9848 - DNA, 13 bp, Artificial Sequence
  synthetic sequence
tgtatatcccagt

SEQ ID NO: 9849 - DNA, 13 bp, Artificial Sequence
  synthetic sequence
atagtcaaattag

SEQ ID NO: 9850 - DNA, 13 bp, Artificial Sequence
  synthetic sequence
caaggtaccagac

SEQ ID NO: 9851 - DNA, 13 bp, Artificial Sequence
  synthetic sequence
gaatttgtgcaaa

SEQ ID NO: 9852 - DNA, 13 bp, Artificial Sequence
  synthetic sequence
catgcaatgctct

SEQ ID NO: 9853 - DNA, 13 bp, Artificial Sequence
  synthetic sequence
atgttattgctag

SEQ ID NO: 9854 - DNA, 13 bp, Artificial Sequence
  synthetic sequence
gaaagtacgcacc

SEQ ID NO: 9855 - DNA, 13 bp, Artificial Sequence
  synthetic sequence
atatttaatagac

SEQ ID NO: 9856 - DNA, 13 bp, Artificial Sequence
  synthetic sequence
aaagatgctgccc

SEQ ID NO: 9857 - DNA, 13 bp, Artificial Sequence
  synthetic sequence
gaatatagaacca

SEQ ID NO: 9858 - DNA, 13 bp, Artificial Sequence
  synthetic sequence
gggctatcacaga

SEQ ID NO: 9859 - DNA, 13 bp, Artificial Sequence
  synthetic sequence
gatcaagagaaaa

SEQ ID NO: 9860 - DNA, 13 bp, Artificial Sequence
  synthetic sequence
gagtatagaacca

SEQ ID NO: 9861 - DNA, 13 bp, Artificial Sequence
  synthetic sequence
gaggggatattta

SEQ ID NO: 9862 - DNA, 13 bp, Artificial Sequence
  synthetic sequence
atatttaacagac

SEQ ID NO: 9863 - DNA, 13 bp, Artificial Sequence
  synthetic sequence
tgatttgtggaaa

SEQ ID NO: 9864 - DNA, 13 bp, Artificial Sequence
  synthetic sequence
tgattgcctatgg

SEQ ID NO: 9865 - DNA, 13 bp, Artificial Sequence
  synthetic sequence
tcacactactgta

SEQ ID NO: 9866 - DNA, 13 bp, Artificial Sequence
  synthetic sequence
tatcacaaaagat

SEQ ID NO: 9867 - DNA, 13 bp, Artificial Sequence
  synthetic sequence
tgcggaagcagga

SEQ ID NO: 9868 - DNA, 13 bp, Artificial Sequence
  synthetic sequence
ccggtgatagaaa

SEQ ID NO: 9869 - DNA, 13 bp, Artificial Sequence
  synthetic sequence
ttccagttggaca

SEQ ID NO: 9870 - DNA, 13 bp, Artificial Sequence
  synthetic sequence
gggaaaatgtaac

SEQ ID NO: 9871 - DNA, 13 bp, Artificial Sequence
  synthetic sequence
ttggaaaccttta

SEQ ID NO: 9872 - DNA, 13 bp, Artificial Sequence
  synthetic sequence
atagtcaaattgg

SEQ ID NO: 9873 - DNA, 13 bp, Artificial Sequence
  synthetic sequence
gtgccatgtatgg

SEQ ID NO: 9874 - DNA, 13 bp, Artificial Sequence
  synthetic sequence
agtagagctttta

SEQ ID NO: 9875 - DNA, 13 bp, Artificial Sequence
  synthetic sequence
gctctaatcaaaa

SEQ ID NO: 9876 - DNA, 13 bp, Artificial Sequence
  synthetic sequence
gtaatgctagcgt

SEQ ID NO: 9877 - DNA, 13 bp, Artificial Sequence
  synthetic sequence
atacaggggttta

SEQ ID NO: 9878 - DNA, 13 bp, Artificial Sequence
  synthetic sequence
cagctcctgatgc

SEQ ID NO: 9879 - DNA, 13 bp, Artificial Sequence
  synthetic sequence
ggaactctgtaca

SEQ ID NO: 9880 - DNA, 13 bp, Artificial Sequence
  synthetic sequence
tcagcatactcag

SEQ ID NO: 9881 - DNA, 13 bp, Artificial Sequence
  synthetic sequence
ccacacatgcatc

SEQ ID NO: 9882 - DNA, 13 bp, Artificial Sequence
  synthetic sequence
caggtaacaaaat

SEQ ID NO: 9883 - DNA, 13 bp, Artificial Sequence
  synthetic sequence
tttgcttttgact

SEQ ID NO: 9884 - DNA, 13 bp, Artificial Sequence
  synthetic sequence
tagaaaaattaga

SEQ ID NO: 9885 - DNA, 13 bp, Artificial Sequence
  synthetic sequence
tctttcatagatt

SEQ ID NO: 9886 - DNA, 13 bp, Artificial Sequence
  synthetic sequence
ccaaaagtttaga

SEQ ID NO: 9887 - DNA, 13 bp, Artificial Sequence
  synthetic sequence
tacaaagactcaa

SEQ ID NO: 9888 - DNA, 13 bp, Artificial Sequence
  synthetic sequence
tattccttgcctc

SEQ ID NO: 9889 - DNA, 13 bp, Artificial Sequence
  synthetic sequence
tttgaaggttcaa

SEQ ID NO: 9890 - DNA, 13 bp, Artificial Sequence
  synthetic sequence
cttactttaccga

SEQ ID NO: 9891 - DNA, 13 bp, Artificial Sequence
  synthetic sequence
agaccatgcctca

SEQ ID NO: 9892 - DNA, 13 bp, Artificial Sequence
  synthetic sequence
tacacaggaattc

SEQ ID NO: 9893 - DNA, 13 bp, Artificial Sequence
  synthetic sequence
gactggcaatcag

SEQ ID NO: 9894 - DNA, 13 bp, Artificial Sequence
  synthetic sequence
ggaactctataca

SEQ ID NO: 9895 - DNA, 13 bp, Artificial Sequence
  synthetic sequence
cagttggtttcac

SEQ ID NO: 9896 - DNA, 13 bp, Artificial Sequence
  synthetic sequence
ggaggtggaattg

SEQ ID NO: 9897 - DNA, 13 bp, Artificial Sequence
  synthetic sequence
ttgatctgtggaa

SEQ ID NO: 9898 - DNA, 13 bp, Artificial Sequence
  synthetic sequence
aaaccagggacac

SEQ ID NO: 9899 - DNA, 13 bp, Artificial Sequence
  synthetic sequence
tctatgttctgcc

SEQ ID NO: 9900 - DNA, 13 bp, Artificial Sequence
  synthetic sequence
tccaatattattc

SEQ ID NO: 9901 - DNA, 13 bp, Artificial Sequence
  synthetic sequence
gtacacaagataa

SEQ ID NO: 9902 - DNA, 13 bp, Artificial Sequence
  synthetic sequence
gcatgcaatgccc

SEQ ID NO: 9903 - DNA, 13 bp, Artificial Sequence
  synthetic sequence
ggtcacagattca

SEQ ID NO: 9904 - DNA, 13 bp, Artificial Sequence
  synthetic sequence
tgttcatacttag

SEQ ID NO: 9905 - DNA, 13 bp, Artificial Sequence
  synthetic sequence
cagaaaagcaaga

SEQ ID NO: 9906 - DNA, 13 bp, Artificial Sequence
  synthetic sequence
ttcaatattactc

SEQ ID NO: 9907 - DNA, 13 bp, Artificial Sequence
  synthetic sequence
tattcaatactat

SEQ ID NO: 9908 - DNA, 13 bp, Artificial Sequence
  synthetic sequence
ataatggagagga

SEQ ID NO: 9909 - DNA, 13 bp, Artificial Sequence
  synthetic sequence
agatggaccaaag

SEQ ID NO: 9910 - DNA, 13 bp, Artificial Sequence
  synthetic sequence
cagttaccggtga

SEQ ID NO: 9911 - DNA, 13 bp, Artificial Sequence
  synthetic sequence
aactacttgtaga

SEQ ID NO: 9912 - DNA, 13 bp, Artificial Sequence
  synthetic sequence
tagattacttgtg

SEQ ID NO: 9913 - DNA, 13 bp, Artificial Sequence
  synthetic sequence
tatatacaaactt

SEQ ID NO: 9914 - DNA, 13 bp, Artificial Sequence
  synthetic sequence
gtttacagaaaca

SEQ ID NO: 9915 - DNA, 13 bp, Artificial Sequence
  synthetic sequence
ccacacaagattg

SEQ ID NO: 9916 - DNA, 13 bp, Artificial Sequence
  synthetic sequence
atatatgagtatt

SEQ ID NO: 9917 - DNA, 13 bp, Artificial Sequence
  synthetic sequence
acatcccagttgg

SEQ ID NO: 9918 - DNA, 13 bp, Artificial Sequence
  synthetic sequence
actccttgcctcc

SEQ ID NO: 9919 - DNA, 13 bp, Artificial Sequence
  synthetic sequence
cagtcagctatct

SEQ ID NO: 9920 - DNA, 13 bp, Artificial Sequence
  synthetic sequence
tcactgatatcag

SEQ ID NO: 9921 - DNA, 13 bp, Artificial Sequence
  synthetic sequence
cataatatagtga

SEQ ID NO: 9922 - DNA, 13 bp, Artificial Sequence
  synthetic sequence
aacacaggggttt

SEQ ID NO: 9923 - DNA, 13 bp, Artificial Sequence
  synthetic sequence
gctcttagaggtc

SEQ ID NO: 9924 - DNA, 13 bp, Artificial Sequence
  synthetic sequence
ttgacaccaattg

SEQ ID NO: 9925 - DNA, 13 bp, Artificial Sequence
  synthetic sequence
acgaatctaacca

SEQ ID NO: 9926 - DNA, 13 bp, Artificial Sequence
  synthetic sequence
gtctaagactaga

SEQ ID NO: 9927 - DNA, 13 bp, Artificial Sequence
  synthetic sequence
gttctgttgttgg

SEQ ID NO: 9928 - DNA, 13 bp, Artificial Sequence
  synthetic sequence
ttcatgtaaaccc

SEQ ID NO: 9929 - DNA, 13 bp, Artificial Sequence
  synthetic sequence
gggatttttgacc

SEQ ID NO: 9930 - DNA, 13 bp, Artificial Sequence
  synthetic sequence
tcatagcaactga

SEQ ID NO: 9931 - DNA, 13 bp, Artificial Sequence
  synthetic sequence
atcttgctatttg

SEQ ID NO: 9932 - DNA, 13 bp, Artificial Sequence
  synthetic sequence
gatcatctgctct

SEQ ID NO: 9933 - DNA, 13 bp, Artificial Sequence
  synthetic sequence
ccaattagcatat

SEQ ID NO: 9934 - DNA, 13 bp, Artificial Sequence
  synthetic sequence
gctccatttccac

SEQ ID NO: 9935 - DNA, 13 bp, Artificial Sequence
  synthetic sequence
gatcttgcattag

SEQ ID NO: 9936 - DNA, 13 bp, Artificial Sequence
  synthetic sequence
ttaagcctaggat

SEQ ID NO: 9937 - DNA, 13 bp, Artificial Sequence
  synthetic sequence
gcatttggtgctc

SEQ ID NO: 9938 - DNA, 13 bp, Artificial Sequence
  synthetic sequence
agaaaatgtctga

SEQ ID NO: 9939 - DNA, 13 bp, Artificial Sequence
  synthetic sequence
ctggatttattcc

SEQ ID NO: 9940 - DNA, 13 bp, Artificial Sequence
  synthetic sequence
tgcgtgacaaagc

SEQ ID NO: 9941 - DNA, 13 bp, Artificial Sequence
  synthetic sequence
acttcttgagaat

SEQ ID NO: 9942 - DNA, 13 bp, Artificial Sequence
  synthetic sequence
aacaggcaaacca

SEQ ID NO: 9943 - DNA, 13 bp, Artificial Sequence
  synthetic sequence
cataattggtgac

SEQ ID NO: 9944 - DNA, 13 bp, Artificial Sequence
  synthetic sequence
ctgaaattttgat

SEQ ID NO: 9945 - DNA, 13 bp, Artificial Sequence
  synthetic sequence
tctctaagtgcac

SEQ ID NO: 9946 - DNA, 13 bp, Artificial Sequence
  synthetic sequence
acaccagctattg

SEQ ID NO: 9947 - DNA, 13 bp, Artificial Sequence
  synthetic sequence
taagccagttgat

SEQ ID NO: 9948 - DNA, 13 bp, Artificial Sequence
  synthetic sequence
tcagtatctaacc

SEQ ID NO: 9949 - DNA, 13 bp, Artificial Sequence
  synthetic sequence
taaaccctaatta

SEQ ID NO: 9950 - DNA, 13 bp, Artificial Sequence
  synthetic sequence
aagaccctacaaa

SEQ ID NO: 9951 - DNA, 13 bp, Artificial Sequence
  synthetic sequence
aactagccattgg

SEQ ID NO: 9952 - DNA, 13 bp, Artificial Sequence
  synthetic sequence
aatcctgcactgg

SEQ ID NO: 9953 - DNA, 13 bp, Artificial Sequence
  synthetic sequence
catggtgaactca

SEQ ID NO: 9954 - DNA, 13 bp, Artificial Sequence
  synthetic sequence
gttacaaaaggta

SEQ ID NO: 9955 - DNA, 13 bp, Artificial Sequence
  synthetic sequence
tgtgtgtttctgg

SEQ ID NO: 9956 - DNA, 13 bp, Artificial Sequence
  synthetic sequence
cctgcttctgcca

SEQ ID NO: 9957 - DNA, 13 bp, Artificial Sequence
  synthetic sequence
gtccttgcacttt

SEQ ID NO: 9958 - DNA, 13 bp, Artificial Sequence
  synthetic sequence
tctaatggttcta

SEQ ID NO: 9959 - DNA, 13 bp, Artificial Sequence
  synthetic sequence
taagaagaccgat

SEQ ID NO: 9960 - DNA, 13 bp, Artificial Sequence
  synthetic sequence
gagggcattccac

SEQ ID NO: 9961 - DNA, 13 bp, Artificial Sequence
  synthetic sequence
gtctaggtacata

SEQ ID NO: 9962 - DNA, 13 bp, Artificial Sequence
  synthetic sequence
cacaccccactct

SEQ ID NO: 9963 - DNA, 13 bp, Artificial Sequence
  synthetic sequence
tgggtaatattca

SEQ ID NO: 9964 - DNA, 13 bp, Artificial Sequence
  synthetic sequence
tatccatcaaaat

SEQ ID NO: 9965 - DNA, 13 bp, Artificial Sequence
  synthetic sequence
aatgctagtgtgg

SEQ ID NO: 9966 - DNA, 13 bp, Artificial Sequence
  synthetic sequence
tctggtttgcaca

SEQ ID NO: 9967 - DNA, 13 bp, Artificial Sequence
  synthetic sequence
ttgacatgtccaa

SEQ ID NO: 9968 - DNA, 13 bp, Artificial Sequence
  synthetic sequence
gtagctgtgactg

SEQ ID NO: 9969 - DNA, 13 bp, Artificial Sequence
  synthetic sequence
gtttgtacccatc

SEQ ID NO: 9970 - DNA, 13 bp, Artificial Sequence
  synthetic sequence
tgggccttcaaag

SEQ ID NO: 9971 - DNA, 13 bp, Artificial Sequence
  synthetic sequence
cccacataatgat

SEQ ID NO: 9972 - DNA, 13 bp, Artificial Sequence
  synthetic sequence
agccacgattcac

SEQ ID NO: 9973 - DNA, 13 bp, Artificial Sequence
  synthetic sequence
gccggtgcgttaa

SEQ ID NO: 9974 - DNA, 13 bp, Artificial Sequence
  synthetic sequence
agaagaccaatta

SEQ ID NO: 9975 - DNA, 13 bp, Artificial Sequence
  synthetic sequence
ggtttcaattaga

SEQ ID NO: 9976 - DNA, 13 bp, Artificial Sequence
  synthetic sequence
taatgtttgcctg

SEQ ID NO: 9977 - DNA, 13 bp, Artificial Sequence
  synthetic sequence
agagagggtactt

SEQ ID NO: 9978 - DNA, 13 bp, Artificial Sequence
  synthetic sequence
tcaactccatatt

SEQ ID NO: 9979 - DNA, 13 bp, Artificial Sequence
  synthetic sequence
ttaagtctaatgc

SEQ ID NO: 9980 - DNA, 13 bp, Artificial Sequence
  synthetic sequence
ctaacatgatcct

SEQ ID NO: 9981 - DNA, 13 bp, Artificial Sequence
  synthetic sequence
cacccttttcagt

SEQ ID NO: 9982 - DNA, 13 bp, Artificial Sequence
  synthetic sequence
ggtttacacatct

SEQ ID NO: 9983 - DNA, 13 bp, Artificial Sequence
  synthetic sequence
aagatcctacaaa

SEQ ID NO: 9984 - DNA, 13 bp, Artificial Sequence
  synthetic sequence
gttccatagcatc

SEQ ID NO: 9985 - DNA, 13 bp, Artificial Sequence
  synthetic sequence
tagcttctggtaa

SEQ ID NO: 9986 - DNA, 13 bp, Artificial Sequence
  synthetic sequence
acagtagagacca

SEQ ID NO: 9987 - DNA, 13 bp, Artificial Sequence
  synthetic sequence
gctattgatacaa

SEQ ID NO: 9988 - DNA, 13 bp, Artificial Sequence
  synthetic sequence
ctgatttgccagt

SEQ ID NO: 9989 - DNA, 13 bp, Artificial Sequence
  synthetic sequence
aagaagccataat

SEQ ID NO: 9990 - DNA, 13 bp, Artificial Sequence
  synthetic sequence
tcttaagccatga

SEQ ID NO: 9991 - DNA, 13 bp, Artificial Sequence
  synthetic sequence
ctatgcctttgta

SEQ ID NO: 9992 - DNA, 13 bp, Artificial Sequence
  synthetic sequence
tcaagtctctgag

SEQ ID NO: 9993 - DNA, 13 bp, Artificial Sequence
  synthetic sequence
acactggtgacaa

SEQ ID NO: 9994 - DNA, 13 bp, Artificial Sequence
  synthetic sequence
ctttcttttggca

SEQ ID NO: 9995 - DNA, 13 bp, Artificial Sequence
  synthetic sequence
atgtggctgtgac

SEQ ID NO: 9996 - DNA, 13 bp, Artificial Sequence
  synthetic sequence
cgtcattgtaatc

SEQ ID NO: 9997 - DNA, 13 bp, Artificial Sequence
  synthetic sequence
tgagaactgctgg

SEQ ID NO: 9998 - DNA, 13 bp, Artificial Sequence
  synthetic sequence
atacacaccccac

SEQ ID NO: 9999 - DNA, 13 bp, Artificial Sequence
  synthetic sequence
gccttggagtctg

SEQ ID NO: 10000 - DNA, 13 bp, Artificial Sequence
  synthetic sequence
ctctattgccaat

SEQ ID NO: 10001 - DNA, 13 bp, Artificial Sequence
  synthetic sequence
ttactagcatatc

SEQ ID NO: 10002 - DNA, 13 bp, Artificial Sequence
  synthetic sequence
taaactggccatt

SEQ ID NO: 10003 - DNA, 13 bp, Artificial Sequence
  synthetic sequence
tggtgcgttaata

SEQ ID NO: 10004 - DNA, 13 bp, Artificial Sequence
  synthetic sequence
gatttatcccata

SEQ ID NO: 10005 - DNA, 13 bp, Artificial Sequence
  synthetic sequence
ttcccacctacat

SEQ ID NO: 10006 - DNA, 13 bp, Artificial Sequence
  synthetic sequence
agagagggtacct

SEQ ID NO: 10007 - DNA, 13 bp, Artificial Sequence
  synthetic sequence
agcagcaatggga

SEQ ID NO: 10008 - DNA, 13 bp, Artificial Sequence
  synthetic sequence
ctaagtctatgcc

SEQ ID NO: 10009 - DNA, 13 bp, Artificial Sequence
  synthetic sequence
tttgcttccactg

SEQ ID NO: 10010 - DNA, 13 bp, Artificial Sequence
  synthetic sequence
tggagagccatgt

SEQ ID NO: 10011 - DNA, 13 bp, Artificial Sequence
  synthetic sequence
ctggatcacaacc

SEQ ID NO: 10012 - DNA, 13 bp, Artificial Sequence
  synthetic sequence
cttgcacttcctt

SEQ ID NO: 10013 - DNA, 13 bp, Artificial Sequence
  synthetic sequence
gtaagaaggccga

SEQ ID NO: 10014 - DNA, 13 bp, Artificial Sequence
  synthetic sequence
ctccctagcctct

SEQ ID NO: 10015 - DNA, 13 bp, Artificial Sequence
  synthetic sequence
cctcaattaagcg

SEQ ID NO: 10016 - DNA, 13 bp, Artificial Sequence
  synthetic sequence
aaagatctaacat

SEQ ID NO: 10017 - DNA, 13 bp, Artificial Sequence
  synthetic sequence
gtgcccatgcttt

SEQ ID NO: 10018 - DNA, 13 bp, Artificial Sequence
  synthetic sequence
caaccccatattt

SEQ ID NO: 10019 - DNA, 13 bp, Artificial Sequence
  synthetic sequence
cacctagcatggt

SEQ ID NO: 10020 - DNA, 13 bp, Artificial Sequence
  synthetic sequence
tcattactaatcc

SEQ ID NO: 10021 - DNA, 13 bp, Artificial Sequence
  synthetic sequence
atcggtatctaac

SEQ ID NO: 10022 - DNA, 13 bp, Artificial Sequence
  synthetic sequence
attccatacagac

SEQ ID NO: 10023 - DNA, 13 bp, Artificial Sequence
  synthetic sequence
aagtgatagttga

SEQ ID NO: 10024 - DNA, 13 bp, Artificial Sequence
  synthetic sequence
tagtagtagactc

SEQ ID NO: 10025 - DNA, 13 bp, Artificial Sequence
  synthetic sequence
ctgttggtgcaag

SEQ ID NO: 10026 - DNA, 13 bp, Artificial Sequence
  synthetic sequence
aagatgacacctg

SEQ ID NO: 10027 - DNA, 13 bp, Artificial Sequence
  synthetic sequence
gtagagtgtatag

SEQ ID NO: 10028 - DNA, 13 bp, Artificial Sequence
  synthetic sequence
aactgagccatca

SEQ ID NO: 10029 - DNA, 13 bp, Artificial Sequence
  synthetic sequence
ttatttgaaaagg

SEQ ID NO: 10030 - DNA, 13 bp, Artificial Sequence
  synthetic sequence
gtaacttatgatt

SEQ ID NO: 10031 - DNA, 13 bp, Artificial Sequence
  synthetic sequence
atacaaaatagta

SEQ ID NO: 10032 - DNA, 13 bp, Artificial Sequence
  synthetic sequence
atagggaaagtac

SEQ ID NO: 10033 - DNA, 13 bp, Artificial Sequence
  synthetic sequence
atattgaacaaga

SEQ ID NO: 10034 - DNA, 13 bp, Artificial Sequence
  synthetic sequence
ttatgaagaatct

SEQ ID NO: 10035 - DNA, 13 bp, Artificial Sequence
  synthetic sequence
tggatttgaatgg

SEQ ID NO: 10036 - DNA, 13 bp, Artificial Sequence
  synthetic sequence
aataatcataaaa

SEQ ID NO: 10037 - DNA, 13 bp, Artificial Sequence
  synthetic sequence
ataaatttatgat

SEQ ID NO: 10038 - DNA, 13 bp, Artificial Sequence
  synthetic sequence
atgatggatgagg

SEQ ID NO: 10039 - DNA, 13 bp, Artificial Sequence
  synthetic sequence
tctaaagagtatg

SEQ ID NO: 10040 - DNA, 13 bp, Artificial Sequence
  synthetic sequence
atgtatgttagtg

SEQ ID NO: 10041 - DNA, 13 bp, Artificial Sequence
  synthetic sequence
tcaaagtattggt

SEQ ID NO: 10042 - DNA, 13 bp, Artificial Sequence
  synthetic sequence
gaaatggtgcaat

SEQ ID NO: 10043 - DNA, 13 bp, Artificial Sequence
  synthetic sequence
tcatatggaggtg

SEQ ID NO: 10044 - DNA, 13 bp, Artificial Sequence
  synthetic sequence
cagatggctccaa

SEQ ID NO: 10045 - DNA, 13 bp, Artificial Sequence
  synthetic sequence
gattatggtctga

SEQ ID NO: 10046 - DNA, 13 bp, Artificial Sequence
  synthetic sequence
tgcacctatgctc

SEQ ID NO: 10047 - DNA, 13 bp, Artificial Sequence
  synthetic sequence
ataccagattata

SEQ ID NO: 10048 - DNA, 13 bp, Artificial Sequence
  synthetic sequence
aatttttcatttt

SEQ ID NO: 10049 - DNA, 13 bp, Artificial Sequence
  synthetic sequence
tcaccaaagaaaa

SEQ ID NO: 10050 - DNA, 13 bp, Artificial Sequence
  synthetic sequence
acatttaattttg

SEQ ID NO: 10051 - DNA, 13 bp, Artificial Sequence
  synthetic sequence
ctcaggttgcaca

SEQ ID NO: 10052 - DNA, 13 bp, Artificial Sequence
  synthetic sequence
ttcctgattcatt

SEQ ID NO: 10053 - DNA, 13 bp, Artificial Sequence
  synthetic sequence
cagcaatgaccat

SEQ ID NO: 10054 - DNA, 13 bp, Artificial Sequence
  synthetic sequence
tgtccgaggatgg

SEQ ID NO: 10055 - DNA, 13 bp, Artificial Sequence
  synthetic sequence
ctgatagatgtgt

SEQ ID NO: 10056 - DNA, 13 bp, Artificial Sequence
  synthetic sequence
tctttatgtttaa

SEQ ID NO: 10057 - DNA, 13 bp, Artificial Sequence
  synthetic sequence
ataaagggtgatt

SEQ ID NO: 10058 - DNA, 13 bp, Artificial Sequence
  synthetic sequence
caataagagatat

SEQ ID NO: 10059 - DNA, 13 bp, Artificial Sequence
  synthetic sequence
aaacaagaaatat

SEQ ID NO: 10060 - DNA, 13 bp, Artificial Sequence
  synthetic sequence
aattcaagacata

SEQ ID NO: 10061 - DNA, 13 bp, Artificial Sequence
  synthetic sequence
agatacaccagca

SEQ ID NO: 10062 - DNA, 13 bp, Artificial Sequence
  synthetic sequence
tttatcacaacac

SEQ ID NO: 10063 - DNA, 13 bp, Artificial Sequence
  synthetic sequence
tggatatatgatg

SEQ ID NO: 10064 - DNA, 13 bp, Artificial Sequence
  synthetic sequence
taagagagccagg

SEQ ID NO: 10065 - DNA, 13 bp, Artificial Sequence
  synthetic sequence
ttatacctgcagt

SEQ ID NO: 10066 - DNA, 13 bp, Artificial Sequence
  synthetic sequence
tggcagcaataga

SEQ ID NO: 10067 - DNA, 13 bp, Artificial Sequence
  synthetic sequence
agagtggttagat

SEQ ID NO: 10068 - DNA, 13 bp, Artificial Sequence
  synthetic sequence
ggatactcacaca

SEQ ID NO: 10069 - DNA, 13 bp, Artificial Sequence
  synthetic sequence
gctgagataagtt

SEQ ID NO: 10070 - DNA, 13 bp, Artificial Sequence
  synthetic sequence
gttcctttattag

SEQ ID NO: 10071 - DNA, 13 bp, Artificial Sequence
  synthetic sequence
taaaatcaatgtc

SEQ ID NO: 10072 - DNA, 13 bp, Artificial Sequence
  synthetic sequence
aacagattcaagc

SEQ ID NO: 10073 - DNA, 13 bp, Artificial Sequence
  synthetic sequence
gagaatatagata

SEQ ID NO: 10074 - DNA, 13 bp, Artificial Sequence
  synthetic sequence
aagaaaatgaggg

SEQ ID NO: 10075 - DNA, 13 bp, Artificial Sequence
  synthetic sequence
taggttattttga

SEQ ID NO: 10076 - DNA, 13 bp, Artificial Sequence
  synthetic sequence
atgagaggttagg

SEQ ID NO: 10077 - DNA, 13 bp, Artificial Sequence
  synthetic sequence
cttgacccacaca

SEQ ID NO: 10078 - DNA, 13 bp, Artificial Sequence
  synthetic sequence
ggctgcagggtaa

SEQ ID NO: 10079 - DNA, 13 bp, Artificial Sequence
  synthetic sequence
aaaacatttaatt

SEQ ID NO: 10080 - DNA, 13 bp, Artificial Sequence
  synthetic sequence
cacatcactctga

SEQ ID NO: 10081 - DNA, 13 bp, Artificial Sequence
  synthetic sequence
tctctatctgttg

SEQ ID NO: 10082 - DNA, 13 bp, Artificial Sequence
  synthetic sequence
gggtatccaaagt

SEQ ID NO: 10083 - DNA, 13 bp, Artificial Sequence
  synthetic sequence
tactaatacaatg

SEQ ID NO: 10084 - DNA, 13 bp, Artificial Sequence
  synthetic sequence
caattagatctgt

SEQ ID NO: 10085 - DNA, 13 bp, Artificial Sequence
  synthetic sequence
acttagctgccct

SEQ ID NO: 10086 - DNA, 13 bp, Artificial Sequence
  synthetic sequence
taccttcagggaa

SEQ ID NO: 10087 - DNA, 13 bp, Artificial Sequence
  synthetic sequence
aataagctaaaaa

SEQ ID NO: 10088 - DNA, 13 bp, Artificial Sequence
  synthetic sequence
cataatggactcc

SEQ ID NO: 10089 - DNA, 13 bp, Artificial Sequence
  synthetic sequence
atacagaagacca

SEQ ID NO: 10090 - DNA, 13 bp, Artificial Sequence
  synthetic sequence
attttgaaaatat

SEQ ID NO: 10091 - DNA, 13 bp, Artificial Sequence
  synthetic sequence
tgagcattgattt

SEQ ID NO: 10092 - DNA, 13 bp, Artificial Sequence
  synthetic sequence
ttgaataaagtcc

SEQ ID NO: 10093 - DNA, 13 bp, Artificial Sequence
  synthetic sequence
ctataagagtgaa

SEQ ID NO: 10094 - DNA, 13 bp, Artificial Sequence
  synthetic sequence
tagaagtttggag

SEQ ID NO: 10095 - DNA, 13 bp, Artificial Sequence
  synthetic sequence
gctattttgatga

SEQ ID NO: 10096 - DNA, 13 bp, Artificial Sequence
  synthetic sequence
ttaaataagtgtt

SEQ ID NO: 10097 - DNA, 13 bp, Artificial Sequence
  synthetic sequence
gctgcaaacagtt

SEQ ID NO: 10098 - DNA, 13 bp, Artificial Sequence
  synthetic sequence
ctttaatcacatc

SEQ ID NO: 10099 - DNA, 13 bp, Artificial Sequence
  synthetic sequence
atgatggatgaag

SEQ ID NO: 10100 - DNA, 13 bp, Artificial Sequence
  synthetic sequence
tgtcaggacaagt

SEQ ID NO: 10101 - DNA, 13 bp, Artificial Sequence
  synthetic sequence
attcagatgatgc

SEQ ID NO: 10102 - DNA, 13 bp, Artificial Sequence
  synthetic sequence
tatttgcaggggt

SEQ ID NO: 10103 - DNA, 13 bp, Artificial Sequence
  synthetic sequence
catattacatacc

SEQ ID NO: 10104 - DNA, 13 bp, Artificial Sequence
  synthetic sequence
aatcaaagaagat

SEQ ID NO: 10105 - DNA, 13 bp, Artificial Sequence
  synthetic sequence
tgacaatgcagtc

SEQ ID NO: 10106 - DNA, 13 bp, Artificial Sequence
  synthetic sequence
gttaagcatgctg

SEQ ID NO: 10107 - DNA, 13 bp, Artificial Sequence
  synthetic sequence
gttgatttaaaga

SEQ ID NO: 10108 - DNA, 13 bp, Artificial Sequence
  synthetic sequence
aattatattgata

SEQ ID NO: 10109 - DNA, 13 bp, Artificial Sequence
  synthetic sequence
ggggagagtgtgt

SEQ ID NO: 10110 - DNA, 13 bp, Artificial Sequence
  synthetic sequence
tacagtttaagca

SEQ ID NO: 10111 - DNA, 13 bp, Artificial Sequence
  synthetic sequence
tgtttaatgacct

SEQ ID NO: 10112 - DNA, 13 bp, Artificial Sequence
  synthetic sequence
catacaataaggg

SEQ ID NO: 10113 - DNA, 13 bp, Artificial Sequence
  synthetic sequence
ggtttagtgttaa

SEQ ID NO: 10114 - DNA, 13 bp, Artificial Sequence
  synthetic sequence
tttcattctttga

SEQ ID NO: 10115 - DNA, 13 bp, Artificial Sequence
  synthetic sequence
atacagccaagtt

SEQ ID NO: 10116 - DNA, 13 bp, Artificial Sequence
  synthetic sequence
acattcaattttg

SEQ ID NO: 10117 - DNA, 13 bp, Artificial Sequence
  synthetic sequence
ggttacatgatgt

SEQ ID NO: 10118 - DNA, 13 bp, Artificial Sequence
  synthetic sequence
gatagaggttttt

SEQ ID NO: 10119 - DNA, 13 bp, Artificial Sequence
  synthetic sequence
caaaatactggtc

SEQ ID NO: 10120 - DNA, 13 bp, Artificial Sequence
  synthetic sequence
aaaacattcaatt

SEQ ID NO: 10121 - DNA, 13 bp, Artificial Sequence
  synthetic sequence
gctgctaatagct

SEQ ID NO: 10122 - DNA, 13 bp, Artificial Sequence
  synthetic sequence
gatgcattattta

SEQ ID NO: 10123 - DNA, 13 bp, Artificial Sequence
  synthetic sequence
ccaatgctgaatt

SEQ ID NO: 10124 - DNA, 13 bp, Artificial Sequence
  synthetic sequence
aacattctcagaa

SEQ ID NO: 10125 - DNA, 13 bp, Artificial Sequence
  synthetic sequence
gttagagagcact

SEQ ID NO: 10126 - DNA, 13 bp, Artificial Sequence
  synthetic sequence
gacccacacatca

SEQ ID NO: 10127 - DNA, 13 bp, Artificial Sequence
  synthetic sequence
ataaagggagatt

SEQ ID NO: 10128 - DNA, 13 bp, Artificial Sequence
  synthetic sequence
attgcaccaatgc

SEQ ID NO: 10129 - DNA, 13 bp, Artificial Sequence
  synthetic sequence
aggatttagctgc

SEQ ID NO: 10130 - DNA, 13 bp, Artificial Sequence
  synthetic sequence
tacctgctgttac

SEQ ID NO: 10131 - DNA, 13 bp, Artificial Sequence
  synthetic sequence
taaatgttcatcc

SEQ ID NO: 10132 - DNA, 13 bp, Artificial Sequence
  synthetic sequence
ttattaggatgaa

SEQ ID NO: 10133 - DNA, 13 bp, Artificial Sequence
  synthetic sequence
taagaaaatgaga

SEQ ID NO: 10134 - DNA, 13 bp, Artificial Sequence
  synthetic sequence
catatgattatat

SEQ ID NO: 10135 - DNA, 13 bp, Artificial Sequence
  synthetic sequence
attcacataagag

SEQ ID NO: 10136 - DNA, 13 bp, Artificial Sequence
  synthetic sequence
ttaggttctctgt

SEQ ID NO: 10137 - DNA, 13 bp, Artificial Sequence
  synthetic sequence
catttgcactggt

SEQ ID NO: 10138 - DNA, 13 bp, Artificial Sequence
  synthetic sequence
tgttgcattatgc

SEQ ID NO: 10139 - DNA, 13 bp, Artificial Sequence
  synthetic sequence
tctaaagaatatg

SEQ ID NO: 10140 - DNA, 13 bp, Artificial Sequence
  synthetic sequence
cataaattcatga

SEQ ID NO: 10141 - DNA, 13 bp, Artificial Sequence
  synthetic sequence
ccagcatgagaga

SEQ ID NO: 10142 - DNA, 13 bp, Artificial Sequence
  synthetic sequence
ttgatgtcaaggt

SEQ ID NO: 10143 - DNA, 13 bp, Artificial Sequence
  synthetic sequence
aagatttggctgc

SEQ ID NO: 10144 - DNA, 13 bp, Artificial Sequence
  synthetic sequence
atactgaggatca

SEQ ID NO: 10145 - DNA, 13 bp, Artificial Sequence
  synthetic sequence
ttatcggaaaggt

SEQ ID NO: 10146 - DNA, 13 bp, Artificial Sequence
  synthetic sequence
ttcaaaatgaaac

SEQ ID NO: 10147 - DNA, 13 bp, Artificial Sequence
  synthetic sequence
tccagatacacct

SEQ ID NO: 10148 - DNA, 13 bp, Artificial Sequence
  synthetic sequence
tatttgaaaaagg

SEQ ID NO: 10149 - DNA, 13 bp, Artificial Sequence
  synthetic sequence
acaagagacagaa

SEQ ID NO: 10150 - DNA, 13 bp, Artificial Sequence
  synthetic sequence
aaactatatgaag

SEQ ID NO: 10151 - DNA, 13 bp, Artificial Sequence
  synthetic sequence
atatggtgttgtt

SEQ ID NO: 10152 - DNA, 13 bp, Artificial Sequence
  synthetic sequence
tggctacatgatg

SEQ ID NO: 10153 - DNA, 13 bp, Artificial Sequence
  synthetic sequence
gaaataagttatg

SEQ ID NO: 10154 - DNA, 13 bp, Artificial Sequence
  synthetic sequence
ggtgaaaagcatg

SEQ ID NO: 10155 - DNA, 13 bp, Artificial Sequence
  synthetic sequence
agttatgagtatt

SEQ ID NO: 10156 - DNA, 13 bp, Artificial Sequence
  synthetic sequence
ggaagttttggct

SEQ ID NO: 10157 - DNA, 13 bp, Artificial Sequence
  synthetic sequence
cccagtctcctta

SEQ ID NO: 10158 - DNA, 13 bp, Artificial Sequence
  synthetic sequence
acatctatgctcc

SEQ ID NO: 10159 - DNA, 13 bp, Artificial Sequence
  synthetic sequence
aacaataagttaa

SEQ ID NO: 10160 - DNA, 13 bp, Artificial Sequence
  synthetic sequence
aagtgtatatata

SEQ ID NO: 10161 - DNA, 13 bp, Artificial Sequence
  synthetic sequence
ttatcactgtttt

SEQ ID NO: 10162 - DNA, 13 bp, Artificial Sequence
  synthetic sequence
agaaatatttaat

SEQ ID NO: 10163 - DNA, 13 bp, Artificial Sequence
  synthetic sequence
catggtgaacaaa

SEQ ID NO: 10164 - DNA, 13 bp, Artificial Sequence
  synthetic sequence
gatggttcaaaca

SEQ ID NO: 10165 - DNA, 13 bp, Artificial Sequence
  synthetic sequence
tgttattccagac

SEQ ID NO: 10166 - DNA, 13 bp, Artificial Sequence
  synthetic sequence
actggttgaaatc

SEQ ID NO: 10167 - DNA, 13 bp, Artificial Sequence
  synthetic sequence
attgcacccatgc

SEQ ID NO: 10168 - DNA, 13 bp, Artificial Sequence
  synthetic sequence
taagacatgacat

SEQ ID NO: 10169 - DNA, 13 bp, Artificial Sequence
  synthetic sequence
agacacaccatgg

SEQ ID NO: 10170 - DNA, 13 bp, Artificial Sequence
  synthetic sequence
catcactgttttc

SEQ ID NO: 10171 - DNA, 13 bp, Artificial Sequence
  synthetic sequence
cccagtcttttaa

SEQ ID NO: 10172 - DNA, 13 bp, Artificial Sequence
  synthetic sequence
ctttaattacatc

SEQ ID NO: 10173 - DNA, 13 bp, Artificial Sequence
  synthetic sequence
ccatgaccatgca

SEQ ID NO: 10174 - DNA, 13 bp, Artificial Sequence
  synthetic sequence
acatctttatact

SEQ ID NO: 10175 - DNA, 13 bp, Artificial Sequence
  synthetic sequence
taaaatactctct

SEQ ID NO: 10176 - DNA, 13 bp, Artificial Sequence
  synthetic sequence
tttgaagataaaa

SEQ ID NO: 10177 - DNA, 13 bp, Artificial Sequence
  synthetic sequence
aatttcatgaaaa

SEQ ID NO: 10178 - DNA, 13 bp, Artificial Sequence
  synthetic sequence
accacagtatccc

SEQ ID NO: 10179 - DNA, 13 bp, Artificial Sequence
  synthetic sequence
acattctccaaag

SEQ ID NO: 10180 - DNA, 13 bp, Artificial Sequence
  synthetic sequence
tttattacaacac

SEQ ID NO: 10181 - DNA, 13 bp, Artificial Sequence
  synthetic sequence
aaagtattgttcg

SEQ ID NO: 10182 - DNA, 13 bp, Artificial Sequence
  synthetic sequence
tatctattataat

SEQ ID NO: 10183 - DNA, 13 bp, Artificial Sequence
  synthetic sequence
aatagggaaagtc

SEQ ID NO: 10184 - DNA, 13 bp, Artificial Sequence
  synthetic sequence
agggagaaagacc

SEQ ID NO: 10185 - DNA, 13 bp, Artificial Sequence
  synthetic sequence
tgctctttaataa

SEQ ID NO: 10186 - DNA, 13 bp, Artificial Sequence
  synthetic sequence
gattttgtagggt

SEQ ID NO: 10187 - DNA, 13 bp, Artificial Sequence
  synthetic sequence
tgatcctcatatt

SEQ ID NO: 10188 - DNA, 13 bp, Artificial Sequence
  synthetic sequence
tcattattttcat

SEQ ID NO: 10189 - DNA, 13 bp, Artificial Sequence
  synthetic sequence
caaaatagcatcc

SEQ ID NO: 10190 - DNA, 13 bp, Artificial Sequence
  synthetic sequence
ttgaaaacataga

SEQ ID NO: 10191 - DNA, 13 bp, Artificial Sequence
  synthetic sequence
atagatgtcttga

SEQ ID NO: 10192 - DNA, 13 bp, Artificial Sequence
  synthetic sequence
tttcattcttcga

SEQ ID NO: 10193 - DNA, 13 bp, Artificial Sequence
  synthetic sequence
agtaaggttgaaa

SEQ ID NO: 10194 - DNA, 13 bp, Artificial Sequence
  synthetic sequence
tgaatcccattat

SEQ ID NO: 10195 - DNA, 13 bp, Artificial Sequence
  synthetic sequence
tatttggtgttgc

SEQ ID NO: 10196 - DNA, 13 bp, Artificial Sequence
  synthetic sequence
gcaattcaagggg

SEQ ID NO: 10197 - DNA, 13 bp, Artificial Sequence
  synthetic sequence
tcataagtttatg

SEQ ID NO: 10198 - DNA, 13 bp, Artificial Sequence
  synthetic sequence
tggatcatatcta

SEQ ID NO: 10199 - DNA, 13 bp, Artificial Sequence
  synthetic sequence
aaagcctaataga

SEQ ID NO: 10200 - DNA, 13 bp, Artificial Sequence
  synthetic sequence
tttttatctgaca

SEQ ID NO: 10201 - DNA, 13 bp, Artificial Sequence
  synthetic sequence
tcatgttgtgcaa

SEQ ID NO: 10202 - DNA, 13 bp, Artificial Sequence
  synthetic sequence
tcagaccagtcat

SEQ ID NO: 10203 - DNA, 13 bp, Artificial Sequence
  synthetic sequence
ctcatcccacact

SEQ ID NO: 10204 - DNA, 13 bp, Artificial Sequence
  synthetic sequence
gtaccatataatc

SEQ ID NO: 10205 - DNA, 13 bp, Artificial Sequence
  synthetic sequence
caattcttgccat

SEQ ID NO: 10206 - DNA, 13 bp, Artificial Sequence
  synthetic sequence
ctatacgtgacat

SEQ ID NO: 10207 - DNA, 13 bp, Artificial Sequence
  synthetic sequence
gatgatttggtat

SEQ ID NO: 10208 - DNA, 13 bp, Artificial Sequence
  synthetic sequence
aattcagattttg

SEQ ID NO: 10209 - DNA, 13 bp, Artificial Sequence
  synthetic sequence
cacctgatgccca

SEQ ID NO: 10210 - DNA, 13 bp, Artificial Sequence
  synthetic sequence
gtttaagtgcatc

SEQ ID NO: 10211 - DNA, 13 bp, Artificial Sequence
  synthetic sequence
ctactatcaattt

SEQ ID NO: 10212 - DNA, 13 bp, Artificial Sequence
  synthetic sequence
aaccatacattac

SEQ ID NO: 10213 - DNA, 13 bp, Artificial Sequence
  synthetic sequence
tacccaatgacag

SEQ ID NO: 10214 - DNA, 13 bp, Artificial Sequence
  synthetic sequence
gagcctctctatc

SEQ ID NO: 10215 - DNA, 13 bp, Artificial Sequence
  synthetic sequence
aatttaagtgccc

SEQ ID NO: 10216 - DNA, 13 bp, Artificial Sequence
  synthetic sequence
tcagataacttca

SEQ ID NO: 10217 - DNA, 13 bp, Artificial Sequence
  synthetic sequence
agtattggaacca

SEQ ID NO: 10218 - DNA, 13 bp, Artificial Sequence
  synthetic sequence
tgtgctgctgcta

SEQ ID NO: 10219 - DNA, 13 bp, Artificial Sequence
  synthetic sequence
cccttgtcaacat

SEQ ID NO: 10220 - DNA, 13 bp, Artificial Sequence
  synthetic sequence
cacgtgataccca

SEQ ID NO: 10221 - DNA, 13 bp, Artificial Sequence
  synthetic sequence
tgctgcacactgg

SEQ ID NO: 10222 - DNA, 13 bp, Artificial Sequence
  synthetic sequence
cctggtgaccact

SEQ ID NO: 10223 - DNA, 13 bp, Artificial Sequence
  synthetic sequence
tcaagccttgcac

SEQ ID NO: 10224 - DNA, 13 bp, Artificial Sequence
  synthetic sequence
cacggttcatgat

SEQ ID NO: 10225 - DNA, 13 bp, Artificial Sequence
  synthetic sequence
atatgactagcaa

SEQ ID NO: 10226 - DNA, 13 bp, Artificial Sequence
  synthetic sequence
aataatgagacct

SEQ ID NO: 10227 - DNA, 13 bp, Artificial Sequence
  synthetic sequence
taacatcacagtg

SEQ ID NO: 10228 - DNA, 13 bp, Artificial Sequence
  synthetic sequence
ttatgagatgacc

SEQ ID NO: 10229 - DNA, 13 bp, Artificial Sequence
  synthetic sequence
taaacatactctt

SEQ ID NO: 10230 - DNA, 13 bp, Artificial Sequence
  synthetic sequence
catcatagtagtc

SEQ ID NO: 10231 - DNA, 13 bp, Artificial Sequence
  synthetic sequence
tcatgtgctgctt

SEQ ID NO: 10232 - DNA, 13 bp, Artificial Sequence
  synthetic sequence
aatgatttgcaaa

SEQ ID NO: 10233 - DNA, 13 bp, Artificial Sequence
  synthetic sequence
agaacttatgcaa

SEQ ID NO: 10234 - DNA, 13 bp, Artificial Sequence
  synthetic sequence
gtttcaaggcctg

SEQ ID NO: 10235 - DNA, 13 bp, Artificial Sequence
  synthetic sequence
tcccatcatctac

SEQ ID NO: 10236 - DNA, 13 bp, Artificial Sequence
  synthetic sequence
gttgtggaatatt

SEQ ID NO: 10237 - DNA, 13 bp, Artificial Sequence
  synthetic sequence
cttggctagtagc

SEQ ID NO: 10238 - DNA, 13 bp, Artificial Sequence
  synthetic sequence
aacaaatggtatt

SEQ ID NO: 10239 - DNA, 13 bp, Artificial Sequence
  synthetic sequence
tcttcatcatcat

SEQ ID NO: 10240 - DNA, 13 bp, Artificial Sequence
  synthetic sequence
catacttgatgtc

SEQ ID NO: 10241 - DNA, 13 bp, Artificial Sequence
  synthetic sequence
acacagttcttat

SEQ ID NO: 10242 - DNA, 13 bp, Artificial Sequence
  synthetic sequence
caagctcagggaa

SEQ ID NO: 10243 - DNA, 13 bp, Artificial Sequence
  synthetic sequence
atggttcttccca

SEQ ID NO: 10244 - DNA, 13 bp, Artificial Sequence
  synthetic sequence
gcttctagtgcag

SEQ ID NO: 10245 - DNA, 13 bp, Artificial Sequence
  synthetic sequence
tgacaatgattgg

SEQ ID NO: 10246 - DNA, 13 bp, Artificial Sequence
  synthetic sequence
tcctgtgtatgaa

SEQ ID NO: 10247 - DNA, 13 bp, Artificial Sequence
  synthetic sequence
tagtaattgatca

SEQ ID NO: 10248 - DNA, 13 bp, Artificial Sequence
  synthetic sequence
acctccccatggt

SEQ ID NO: 10249 - DNA, 13 bp, Artificial Sequence
  synthetic sequence
actgcttgaagga

SEQ ID NO: 10250 - DNA, 13 bp, Artificial Sequence
  synthetic sequence
acaacaccatcat

SEQ ID NO: 10251 - DNA, 13 bp, Artificial Sequence
  synthetic sequence
cacatatagcctc

SEQ ID NO: 10252 - DNA, 13 bp, Artificial Sequence
  synthetic sequence
tggccatcttcct

SEQ ID NO: 10253 - DNA, 13 bp, Artificial Sequence
  synthetic sequence
cactgagagtcac

SEQ ID NO: 10254 - DNA, 13 bp, Artificial Sequence
  synthetic sequence
gctttattatttt

SEQ ID NO: 10255 - DNA, 13 bp, Artificial Sequence
  synthetic sequence
tatatgtctgtac

SEQ ID NO: 10256 - DNA, 13 bp, Artificial Sequence
  synthetic sequence
agaataaacaata

SEQ ID NO: 10257 - DNA, 13 bp, Artificial Sequence
  synthetic sequence
tacaattgttgtt

SEQ ID NO: 10258 - DNA, 13 bp, Artificial Sequence
  synthetic sequence
aaggcctggaacc

SEQ ID NO: 10259 - DNA, 13 bp, Artificial Sequence
  synthetic sequence
cctagctcacgat

SEQ ID NO: 10260 - DNA, 13 bp, Artificial Sequence
  synthetic sequence
ttccggactaaat

SEQ ID NO: 10261 - DNA, 13 bp, Artificial Sequence
  synthetic sequence
tctatcagtgaag

SEQ ID NO: 10262 - DNA, 13 bp, Artificial Sequence
  synthetic sequence
tcttcaatatttg

SEQ ID NO: 10263 - DNA, 13 bp, Artificial Sequence
  synthetic sequence
attgtctctgccc

SEQ ID NO: 10264 - DNA, 13 bp, Artificial Sequence
  synthetic sequence
atgcatcatattg

SEQ ID NO: 10265 - DNA, 13 bp, Artificial Sequence
  synthetic sequence
aactagcctcata

SEQ ID NO: 10266 - DNA, 13 bp, Artificial Sequence
  synthetic sequence
tctttagaatagt

SEQ ID NO: 10267 - DNA, 13 bp, Artificial Sequence
  synthetic sequence
tagaatcctgtgg

SEQ ID NO: 10268 - DNA, 13 bp, Artificial Sequence
  synthetic sequence
tttgctttacacc

SEQ ID NO: 10269 - DNA, 13 bp, Artificial Sequence
  synthetic sequence
tatcttctcttgt

SEQ ID NO: 10270 - DNA, 13 bp, Artificial Sequence
  synthetic sequence
cagcattctcccg

SEQ ID NO: 10271 - DNA, 13 bp, Artificial Sequence
  synthetic sequence
aaataatatgaca

SEQ ID NO: 10272 - DNA, 13 bp, Artificial Sequence
  synthetic sequence
cttcaacatttcc

SEQ ID NO: 10273 - DNA, 13 bp, Artificial Sequence
  synthetic sequence
ctcacgataaact

SEQ ID NO: 10274 - DNA, 13 bp, Artificial Sequence
  synthetic sequence
taccttagaatag

SEQ ID NO: 10275 - DNA, 13 bp, Artificial Sequence
  synthetic sequence
gacttaaatggac

SEQ ID NO: 10276 - DNA, 13 bp, Artificial Sequence
  synthetic sequence
tcttctttacggt

SEQ ID NO: 10277 - DNA, 13 bp, Artificial Sequence
  synthetic sequence
tcagttccatcat

SEQ ID NO: 10278 - DNA, 13 bp, Artificial Sequence
  synthetic sequence
atggttcctccca

SEQ ID NO: 10279 - DNA, 13 bp, Artificial Sequence
  synthetic sequence
gaatatttggttt

SEQ ID NO: 10280 - DNA, 13 bp, Artificial Sequence
  synthetic sequence
gattcaccatcaa

SEQ ID NO: 10281 - DNA, 13 bp, Artificial Sequence
  synthetic sequence
ttacgagacatag

SEQ ID NO: 10282 - DNA, 13 bp, Artificial Sequence
  synthetic sequence
ctatatgccatgc

SEQ ID NO: 10283 - DNA, 13 bp, Artificial Sequence
  synthetic sequence
atttgagtgccca

SEQ ID NO: 10284 - DNA, 13 bp, Artificial Sequence
  synthetic sequence
ttaatgtttgaaa

SEQ ID NO: 10285 - DNA, 13 bp, Artificial Sequence
  synthetic sequence
gtcaattaatata

SEQ ID NO: 10286 - DNA, 13 bp, Artificial Sequence
  synthetic sequence
aacatgcttttcc

SEQ ID NO: 10287 - DNA, 13 bp, Artificial Sequence
  synthetic sequence
gcaatggcatcat

SEQ ID NO: 10288 - DNA, 13 bp, Artificial Sequence
  synthetic sequence
tatggctagcaat

SEQ ID NO: 10289 - DNA, 13 bp, Artificial Sequence
  synthetic sequence
aaaatgaaaaaga

SEQ ID NO: 10290 - DNA, 13 bp, Artificial Sequence
  synthetic sequence
tcatcatcaagtt

SEQ ID NO: 10291 - DNA, 13 bp, Artificial Sequence
  synthetic sequence
atctaaaaactgt

SEQ ID NO: 10292 - DNA, 13 bp, Artificial Sequence
  synthetic sequence
gatattaaactcc

SEQ ID NO: 10293 - DNA, 13 bp, Artificial Sequence
  synthetic sequence
aacataagtgtgc

SEQ ID NO: 10294 - DNA, 13 bp, Artificial Sequence
  synthetic sequence
gcctcatttgaat

SEQ ID NO: 10295 - DNA, 13 bp, Artificial Sequence
  synthetic sequence
ctgttggatgatt

SEQ ID NO: 10296 - DNA, 13 bp, Artificial Sequence
  synthetic sequence
cacgattcataat

SEQ ID NO: 10297 - DNA, 13 bp, Artificial Sequence
  synthetic sequence
caatcctagccat

SEQ ID NO: 10298 - DNA, 13 bp, Artificial Sequence
  synthetic sequence
ttaacacacctac

SEQ ID NO: 10299 - DNA, 13 bp, Artificial Sequence
  synthetic sequence
aaccaataacagc

SEQ ID NO: 10300 - DNA, 13 bp, Artificial Sequence
  synthetic sequence
cccttgataccca

SEQ ID NO: 10301 - DNA, 13 bp, Artificial Sequence
  synthetic sequence
ggtgaccatttag

SEQ ID NO: 10302 - DNA, 13 bp, Artificial Sequence
  synthetic sequence
taaatggccatct

SEQ ID NO: 10303 - DNA, 13 bp, Artificial Sequence
  synthetic sequence
cttatattgaact

SEQ ID NO: 10304 - DNA, 13 bp, Artificial Sequence
  synthetic sequence
tgtgtgcttatat

SEQ ID NO: 10305 - DNA, 13 bp, Artificial Sequence
  synthetic sequence
cagttaaatcata

SEQ ID NO: 10306 - DNA, 13 bp, Artificial Sequence
  synthetic sequence
aagtgatttgcaa

SEQ ID NO: 10307 - DNA, 13 bp, Artificial Sequence
  synthetic sequence
ggtaatgatatat

SEQ ID NO: 10308 - DNA, 13 bp, Artificial Sequence
  synthetic sequence
tgacatcacaatg

SEQ ID NO: 10309 - DNA, 13 bp, Artificial Sequence
  synthetic sequence
ctgcatactttca

SEQ ID NO: 10310 - DNA, 13 bp, Artificial Sequence
  synthetic sequence
acagccttcaaaa

SEQ ID NO: 10311 - DNA, 13 bp, Artificial Sequence
  synthetic sequence
tgctgttcagcca

SEQ ID NO: 10312 - DNA, 13 bp, Artificial Sequence
  synthetic sequence
gctgttgcaatta

SEQ ID NO: 10313 - DNA, 13 bp, Artificial Sequence
  synthetic sequence
aggttcttcccag

SEQ ID NO: 10314 - DNA, 13 bp, Artificial Sequence
  synthetic sequence
cattatttgcctt

SEQ ID NO: 10315 - DNA, 13 bp, Artificial Sequence
  synthetic sequence
agctttctcctga

SEQ ID NO: 10316 - DNA, 13 bp, Artificial Sequence
  synthetic sequence
atgcttgatgtta

SEQ ID NO: 10317 - DNA, 13 bp, Artificial Sequence
  synthetic sequence
actcgatgtcaac

SEQ ID NO: 10318 - DNA, 13 bp, Artificial Sequence
  synthetic sequence
tctcctcagataa

SEQ ID NO: 10319 - DNA, 13 bp, Artificial Sequence
  synthetic sequence
aaccatacattgc

SEQ ID NO: 10320 - DNA, 13 bp, Artificial Sequence
  synthetic sequence
atacctgtttaaa

SEQ ID NO: 10321 - DNA, 13 bp, Artificial Sequence
  synthetic sequence
tcataatagtctt

SEQ ID NO: 10322 - DNA, 13 bp, Artificial Sequence
  synthetic sequence
aatagatctcctg

SEQ ID NO: 10323 - DNA, 13 bp, Artificial Sequence
  synthetic sequence
actgaatttctgg

SEQ ID NO: 10324 - DNA, 13 bp, Artificial Sequence
  synthetic sequence
cccaaaatatctc

SEQ ID NO: 10325 - DNA, 13 bp, Artificial Sequence
  synthetic sequence
aacaaatccccag

SEQ ID NO: 10326 - DNA, 13 bp, Artificial Sequence
  synthetic sequence
tcaacataagtat

SEQ ID NO: 10327 - DNA, 13 bp, Artificial Sequence
  synthetic sequence
tcaacatcagcag

SEQ ID NO: 10328 - DNA, 13 bp, Artificial Sequence
  synthetic sequence
atgtccatcagga

SEQ ID NO: 10329 - DNA, 13 bp, Artificial Sequence
  synthetic sequence
ttgttattttgtg

SEQ ID NO: 10330 - DNA, 13 bp, Artificial Sequence
  synthetic sequence
aagaatttgtgta

SEQ ID NO: 10331 - DNA, 13 bp, Artificial Sequence
  synthetic sequence
actttcatgtgtt

SEQ ID NO: 10332 - DNA, 13 bp, Artificial Sequence
  synthetic sequence
cagaccaatcatg

SEQ ID NO: 10333 - DNA, 13 bp, Artificial Sequence
  synthetic sequence
gctcgcctgctat

SEQ ID NO: 10334 - DNA, 13 bp, Artificial Sequence
  synthetic sequence
tcaggacatatcc

SEQ ID NO: 10335 - DNA, 13 bp, Artificial Sequence
  synthetic sequence
ctcaaacaacttc

SEQ ID NO: 10336 - DNA, 13 bp, Artificial Sequence
  synthetic sequence
ttgtgtataaacc

SEQ ID NO: 10337 - DNA, 13 bp, Artificial Sequence
  synthetic sequence
cctgctctgtatt

SEQ ID NO: 10338 - DNA, 13 bp, Artificial Sequence
  synthetic sequence
tgcaaggcctgat

SEQ ID NO: 10339 - DNA, 13 bp, Artificial Sequence
  synthetic sequence
ctttgagtaatca

SEQ ID NO: 10340 - DNA, 13 bp, Artificial Sequence
  synthetic sequence
tcaggaaataaat

SEQ ID NO: 10341 - DNA, 13 bp, Artificial Sequence
  synthetic sequence
tgttcatggagat

SEQ ID NO: 10342 - DNA, 13 bp, Artificial Sequence
  synthetic sequence
atctggaaagaaa

SEQ ID NO: 10343 - DNA, 13 bp, Artificial Sequence
  synthetic sequence
gactatcttcatc

SEQ ID NO: 10344 - DNA, 13 bp, Artificial Sequence
  synthetic sequence
agctgttgctaac

SEQ ID NO: 10345 - DNA, 13 bp, Artificial Sequence
  synthetic sequence
tacaaggaatatt

SEQ ID NO: 10346 - DNA, 13 bp, Artificial Sequence
  synthetic sequence
tgacagatgaaga

SEQ ID NO: 10347 - DNA, 13 bp, Artificial Sequence
  synthetic sequence
ttgtctcaagacc

SEQ ID NO: 10348 - DNA, 13 bp, Artificial Sequence
  synthetic sequence
aagaactttcatc

SEQ ID NO: 10349 - DNA, 13 bp, Artificial Sequence
  synthetic sequence
aagaagtctgtct

SEQ ID NO: 10350 - DNA, 13 bp, Artificial Sequence
  synthetic sequence
gtgaaaattttcc

SEQ ID NO: 10351 - DNA, 13 bp, Artificial Sequence
  synthetic sequence
gtttcaagaccag

SEQ ID NO: 10352 - DNA, 13 bp, Artificial Sequence
  synthetic sequence
ataacatcacaat

SEQ ID NO: 10353 - DNA, 13 bp, Artificial Sequence
  synthetic sequence
gatagcttcaata

SEQ ID NO: 10354 - DNA, 13 bp, Artificial Sequence
  synthetic sequence
caaatttataacc

SEQ ID NO: 10355 - DNA, 13 bp, Artificial Sequence
  synthetic sequence
ccccttatcaaca

SEQ ID NO: 10356 - DNA, 13 bp, Artificial Sequence
  synthetic sequence
gattttgatggga

SEQ ID NO: 10357 - DNA, 13 bp, Artificial Sequence
  synthetic sequence
atctaaggcttta

SEQ ID NO: 10358 - DNA, 13 bp, Artificial Sequence
  synthetic sequence
tcaaattcagact

SEQ ID NO: 10359 - DNA, 13 bp, Artificial Sequence
  synthetic sequence
attgagacagcac

SEQ ID NO: 10360 - DNA, 13 bp, Artificial Sequence
  synthetic sequence
aaaaagtctgtct

SEQ ID NO: 10361 - DNA, 13 bp, Artificial Sequence
  synthetic sequence
tcaccctttagaa

SEQ ID NO: 10362 - DNA, 13 bp, Artificial Sequence
  synthetic sequence
gctttattattct

SEQ ID NO: 10363 - DNA, 13 bp, Artificial Sequence
  synthetic sequence
taactaagtaaat

SEQ ID NO: 10364 - DNA, 13 bp, Artificial Sequence
  synthetic sequence
gtttgcacacagt

SEQ ID NO: 10365 - DNA, 13 bp, Artificial Sequence
  synthetic sequence
atcaatgggtggg

SEQ ID NO: 10366 - DNA, 13 bp, Artificial Sequence
  synthetic sequence
caactaagtcctc

SEQ ID NO: 10367 - DNA, 13 bp, Artificial Sequence
  synthetic sequence
catacctggtgct

SEQ ID NO: 10368 - DNA, 13 bp, Artificial Sequence
  synthetic sequence
tctattaatgaag

SEQ ID NO: 10369 - DNA, 13 bp, Artificial Sequence
  synthetic sequence
ctcatcccacacc

SEQ ID NO: 10370 - DNA, 13 bp, Artificial Sequence
  synthetic sequence
acgattcatgatc

SEQ ID NO: 10371 - DNA, 13 bp, Artificial Sequence
  synthetic sequence
ccaatatatatgc

SEQ ID NO: 10372 - DNA, 13 bp, Artificial Sequence
  synthetic sequence
caatgccttttca

SEQ ID NO: 10373 - DNA, 13 bp, Artificial Sequence
  synthetic sequence
atggaagaataaa

SEQ ID NO: 10374 - DNA, 13 bp, Artificial Sequence
  synthetic sequence
attatcaacatat

SEQ ID NO: 10375 - DNA, 13 bp, Artificial Sequence
  synthetic sequence
gtctaaattatcc

SEQ ID NO: 10376 - DNA, 13 bp, Artificial Sequence
  synthetic sequence
aaagacgtccaga

SEQ ID NO: 10377 - DNA, 13 bp, Artificial Sequence
  synthetic sequence
tcagctaggaatg

SEQ ID NO: 10378 - DNA, 13 bp, Artificial Sequence
  synthetic sequence
ctgctaaaggaag

SEQ ID NO: 10379 - DNA, 13 bp, Artificial Sequence
  synthetic sequence
gatcaaatctcag

SEQ ID NO: 10380 - DNA, 13 bp, Artificial Sequence
  synthetic sequence
gaaagtattatca

SEQ ID NO: 10381 - DNA, 13 bp, Artificial Sequence
  synthetic sequence
ttttaatcgggaa

SEQ ID NO: 10382 - DNA, 13 bp, Artificial Sequence
  synthetic sequence
caatcactggccg

SEQ ID NO: 10383 - DNA, 13 bp, Artificial Sequence
  synthetic sequence
aaggctaatcaga

SEQ ID NO: 10384 - DNA, 13 bp, Artificial Sequence
  synthetic sequence
aatttggagtaga

SEQ ID NO: 10385 - DNA, 13 bp, Artificial Sequence
  synthetic sequence
gacaaaactagag

SEQ ID NO: 10386 - DNA, 13 bp, Artificial Sequence
  synthetic sequence
cccaaaccttgaa

SEQ ID NO: 10387 - DNA, 13 bp, Artificial Sequence
  synthetic sequence
gcatctggtgttc

SEQ ID NO: 10388 - DNA, 13 bp, Artificial Sequence
  synthetic sequence
aagtcagcatgca

SEQ ID NO: 10389 - DNA, 13 bp, Artificial Sequence
  synthetic sequence
ccttgggaatgtg

SEQ ID NO: 10390 - DNA, 13 bp, Artificial Sequence
  synthetic sequence
cacgctttttgac

SEQ ID NO: 10391 - DNA, 13 bp, Artificial Sequence
  synthetic sequence
atggatgctgagg

SEQ ID NO: 10392 - DNA, 13 bp, Artificial Sequence
  synthetic sequence
tctcagaagcata

SEQ ID NO: 10393 - DNA, 13 bp, Artificial Sequence
  synthetic sequence
tagagaatcatgg

SEQ ID NO: 10394 - DNA, 13 bp, Artificial Sequence
  synthetic sequence
tggcccttacact

SEQ ID NO: 10395 - DNA, 13 bp, Artificial Sequence
  synthetic sequence
tgaagagatcacg

SEQ ID NO: 10396 - DNA, 13 bp, Artificial Sequence
  synthetic sequence
caacattaagagg

SEQ ID NO: 10397 - DNA, 13 bp, Artificial Sequence
  synthetic sequence
agtgctttgaagc

SEQ ID NO: 10398 - DNA, 13 bp, Artificial Sequence
  synthetic sequence
caactgggtttct

SEQ ID NO: 10399 - DNA, 13 bp, Artificial Sequence
  synthetic sequence
cagcttcaagggt

SEQ ID NO: 10400 - DNA, 13 bp, Artificial Sequence
  synthetic sequence
cagaattcaaaag

SEQ ID NO: 10401 - DNA, 13 bp, Artificial Sequence
  synthetic sequence
ttactctcacgag

SEQ ID NO: 10402 - DNA, 13 bp, Artificial Sequence
  synthetic sequence
ccaaatctctgag

SEQ ID NO: 10403 - DNA, 13 bp, Artificial Sequence
  synthetic sequence
gaggctgcctatc

SEQ ID NO: 10404 - DNA, 13 bp, Artificial Sequence
  synthetic sequence
ctgtccatcctcc

SEQ ID NO: 10405 - DNA, 13 bp, Artificial Sequence
  synthetic sequence
acttgctggactt

SEQ ID NO: 10406 - DNA, 13 bp, Artificial Sequence
  synthetic sequence
tgtttttgtttag

SEQ ID NO: 10407 - DNA, 13 bp, Artificial Sequence
  synthetic sequence
atgcaatctgata

SEQ ID NO: 10408 - DNA, 13 bp, Artificial Sequence
  synthetic sequence
tccaagagtatga

SEQ ID NO: 10409 - DNA, 13 bp, Artificial Sequence
  synthetic sequence
ccaggagcctgtg

SEQ ID NO: 10410 - DNA, 13 bp, Artificial Sequence
  synthetic sequence
taaataccttatt

SEQ ID NO: 10411 - DNA, 13 bp, Artificial Sequence
  synthetic sequence
gaaaaagagcaag

SEQ ID NO: 10412 - DNA, 13 bp, Artificial Sequence
  synthetic sequence
gaagtcagaacaa

SEQ ID NO: 10413 - DNA, 13 bp, Artificial Sequence
  synthetic sequence
ttgcacatgtgga

SEQ ID NO: 10414 - DNA, 13 bp, Artificial Sequence
  synthetic sequence
agcaggggttgct

SEQ ID NO: 10415 - DNA, 13 bp, Artificial Sequence
  synthetic sequence
gctgcttgtcatg

SEQ ID NO: 10416 - DNA, 13 bp, Artificial Sequence
  synthetic sequence
atgctgattgagg

SEQ ID NO: 10417 - DNA, 13 bp, Artificial Sequence
  synthetic sequence
aagagaaacttca

SEQ ID NO: 10418 - DNA, 13 bp, Artificial Sequence
  synthetic sequence
tttggttcatgat

SEQ ID NO: 10419 - DNA, 13 bp, Artificial Sequence
  synthetic sequence
tctctctaacata

SEQ ID NO: 10420 - DNA, 13 bp, Artificial Sequence
  synthetic sequence
ctgggtagtgaag

SEQ ID NO: 10421 - DNA, 13 bp, Artificial Sequence
  synthetic sequence
tgtgatgacatta

SEQ ID NO: 10422 - DNA, 13 bp, Artificial Sequence
  synthetic sequence
aagccagcctcag

SEQ ID NO: 10423 - DNA, 13 bp, Artificial Sequence
  synthetic sequence
catggaaggctgt

SEQ ID NO: 10424 - DNA, 13 bp, Artificial Sequence
  synthetic sequence
cacaaaccttggc

SEQ ID NO: 10425 - DNA, 13 bp, Artificial Sequence
  synthetic sequence
ttcagtaagcccc

SEQ ID NO: 10426 - DNA, 13 bp, Artificial Sequence
  synthetic sequence
ttgaaagaaacat

SEQ ID NO: 10427 - DNA, 13 bp, Artificial Sequence
  synthetic sequence
ctacatatctcca

SEQ ID NO: 10428 - DNA, 13 bp, Artificial Sequence
  synthetic sequence
attaagccactct

SEQ ID NO: 10429 - DNA, 13 bp, Artificial Sequence
  synthetic sequence
gaggatagatgaa

SEQ ID NO: 10430 - DNA, 13 bp, Artificial Sequence
  synthetic sequence
ggtttcattttgg

SEQ ID NO: 10431 - DNA, 13 bp, Artificial Sequence
  synthetic sequence
acacccctaaggc

SEQ ID NO: 10432 - DNA, 13 bp, Artificial Sequence
  synthetic sequence
cctgctcagagct

SEQ ID NO: 10433 - DNA, 13 bp, Artificial Sequence
  synthetic sequence
atagatggtgatg

SEQ ID NO: 10434 - DNA, 13 bp, Artificial Sequence
  synthetic sequence
aaggcatattttt

SEQ ID NO: 10435 - DNA, 13 bp, Artificial Sequence
  synthetic sequence
tcctacctatgga

SEQ ID NO: 10436 - DNA, 13 bp, Artificial Sequence
  synthetic sequence
ccagcttcagcaa

SEQ ID NO: 10437 - DNA, 13 bp, Artificial Sequence
  synthetic sequence
cgagctaaatgcc

SEQ ID NO: 10438 - DNA, 13 bp, Artificial Sequence
  synthetic sequence
ggttcatgccagc

SEQ ID NO: 10439 - DNA, 13 bp, Artificial Sequence
  synthetic sequence
aagaccgtccaga

SEQ ID NO: 10440 - DNA, 13 bp, Artificial Sequence
  synthetic sequence
ccacatttctgca

SEQ ID NO: 10441 - DNA, 13 bp, Artificial Sequence
  synthetic sequence
ccttgaaaatgtt

SEQ ID NO: 10442 - DNA, 13 bp, Artificial Sequence
  synthetic sequence
tttagatagtgct

SEQ ID NO: 10443 - DNA, 13 bp, Artificial Sequence
  synthetic sequence
tgagtatagcaag

SEQ ID NO: 10444 - DNA, 13 bp, Artificial Sequence
  synthetic sequence
tgatttgtcttcc

SEQ ID NO: 10445 - DNA, 13 bp, Artificial Sequence
  synthetic sequence
ctctgtagctaag

SEQ ID NO: 10446 - DNA, 13 bp, Artificial Sequence
  synthetic sequence
ctccctctcttat

SEQ ID NO: 10447 - DNA, 13 bp, Artificial Sequence
  synthetic sequence
cttctaacttttc

SEQ ID NO: 10448 - DNA, 13 bp, Artificial Sequence
  synthetic sequence
gcactttttctgc

SEQ ID NO: 10449 - DNA, 13 bp, Artificial Sequence
  synthetic sequence
tcccccttggttt

SEQ ID NO: 10450 - DNA, 13 bp, Artificial Sequence
  synthetic sequence
ccatctagtcttg

SEQ ID NO: 10451 - DNA, 13 bp, Artificial Sequence
  synthetic sequence
cttcaagacattg

SEQ ID NO: 10452 - DNA, 13 bp, Artificial Sequence
  synthetic sequence
taagaagacctca

SEQ ID NO: 10453 - DNA, 13 bp, Artificial Sequence
  synthetic sequence
aacaacaggttga

SEQ ID NO: 10454 - DNA, 13 bp, Artificial Sequence
  synthetic sequence
atcaaatagcctg

SEQ ID NO: 10455 - DNA, 13 bp, Artificial Sequence
  synthetic sequence
ttgtagccaatgc

SEQ ID NO: 10456 - DNA, 13 bp, Artificial Sequence
  synthetic sequence
ccttgattcctct

SEQ ID NO: 10457 - DNA, 13 bp, Artificial Sequence
  synthetic sequence
cttcctccaggat

SEQ ID NO: 10458 - DNA, 13 bp, Artificial Sequence
  synthetic sequence
tgtgatgctgagt

SEQ ID NO: 10459 - DNA, 13 bp, Artificial Sequence
  synthetic sequence
tcttctttgtttt

SEQ ID NO: 10460 - DNA, 13 bp, Artificial Sequence
  synthetic sequence
ttccctcaggcct

SEQ ID NO: 10461 - DNA, 13 bp, Artificial Sequence
  synthetic sequence
gaaagcttcccat

SEQ ID NO: 10462 - DNA, 13 bp, Artificial Sequence
  synthetic sequence
actgatggcgatc

SEQ ID NO: 10463 - DNA, 13 bp, Artificial Sequence
  synthetic sequence
atgttcgagacat

SEQ ID NO: 10464 - DNA, 13 bp, Artificial Sequence
  synthetic sequence
cttagtcagtcca

SEQ ID NO: 10465 - DNA, 13 bp, Artificial Sequence
  synthetic sequence
ccttgtaatgaaa

SEQ ID NO: 10466 - DNA, 13 bp, Artificial Sequence
  synthetic sequence
gactaaatgcttg

SEQ ID NO: 10467 - DNA, 13 bp, Artificial Sequence
  synthetic sequence
gcctcatattcct

SEQ ID NO: 10468 - DNA, 13 bp, Artificial Sequence
  synthetic sequence
tatgggccatggt

SEQ ID NO: 10469 - DNA, 13 bp, Artificial Sequence
  synthetic sequence
aaggttgaatcta

SEQ ID NO: 10470 - DNA, 13 bp, Artificial Sequence
  synthetic sequence
gggttagctattg

SEQ ID NO: 10471 - DNA, 13 bp, Artificial Sequence
  synthetic sequence
atcttcttgcacc

SEQ ID NO: 10472 - DNA, 13 bp, Artificial Sequence
  synthetic sequence
atgcaggatccct

SEQ ID NO: 10473 - DNA, 13 bp, Artificial Sequence
  synthetic sequence
ccaatgttttcaa

SEQ ID NO: 10474 - DNA, 13 bp, Artificial Sequence
  synthetic sequence
gaccctcctctct

SEQ ID NO: 10475 - DNA, 13 bp, Artificial Sequence
  synthetic sequence
gtgcaaaatattg

SEQ ID NO: 10476 - DNA, 13 bp, Artificial Sequence
  synthetic sequence
tcctgagctaagc

SEQ ID NO: 10477 - DNA, 13 bp, Artificial Sequence
  synthetic sequence
ccagtccttggga

SEQ ID NO: 10478 - DNA, 13 bp, Artificial Sequence
  synthetic sequence
ccgcatcaattgt

SEQ ID NO: 10479 - DNA, 13 bp, Artificial Sequence
  synthetic sequence
ctattagttcagc

SEQ ID NO: 10480 - DNA, 13 bp, Artificial Sequence
  synthetic sequence
atttgaagagttg

SEQ ID NO: 10481 - DNA, 13 bp, Artificial Sequence
  synthetic sequence
caagcagagcccg

SEQ ID NO: 10482 - DNA, 13 bp, Artificial Sequence
  synthetic sequence
atcttctgagcat

SEQ ID NO: 10483 - DNA, 13 bp, Artificial Sequence
  synthetic sequence
gatgacttagtgg

SEQ ID NO: 10484 - DNA, 13 bp, Artificial Sequence
  synthetic sequence
ccacttctgctgc

SEQ ID NO: 10485 - DNA, 13 bp, Artificial Sequence
  synthetic sequence
ttcagcttcatct

SEQ ID NO: 10486 - DNA, 13 bp, Artificial Sequence
  synthetic sequence
ccacaatggggaa

SEQ ID NO: 10487 - DNA, 13 bp, Artificial Sequence
  synthetic sequence
tgcaatgaccccg

SEQ ID NO: 10488 - DNA, 13 bp, Artificial Sequence
  synthetic sequence
cccagctaagtct

SEQ ID NO: 10489 - DNA, 13 bp, Artificial Sequence
  synthetic sequence
gaagcaatgtctt

SEQ ID NO: 10490 - DNA, 13 bp, Artificial Sequence
  synthetic sequence
aacatctatagct

SEQ ID NO: 10491 - DNA, 13 bp, Artificial Sequence
  synthetic sequence
ccctcaaccctct

SEQ ID NO: 10492 - DNA, 13 bp, Artificial Sequence
  synthetic sequence
ctgtgagcgcagt

SEQ ID NO: 10493 - DNA, 13 bp, Artificial Sequence
  synthetic sequence
tccattaatttta

SEQ ID NO: 10494 - DNA, 13 bp, Artificial Sequence
  synthetic sequence
gctccttgctgct

SEQ ID NO: 10495 - DNA, 13 bp, Artificial Sequence
  synthetic sequence
gtcacggtatttt

SEQ ID NO: 10496 - DNA, 13 bp, Artificial Sequence
  synthetic sequence
tctccttctcaag

SEQ ID NO: 10497 - DNA, 13 bp, Artificial Sequence
  synthetic sequence
ttgagttgagcat

SEQ ID NO: 10498 - DNA, 13 bp, Artificial Sequence
  synthetic sequence
tgtttctttatga

SEQ ID NO: 10499 - DNA, 13 bp, Artificial Sequence
  synthetic sequence
tgctagtgtctcc

SEQ ID NO: 10500 - DNA, 13 bp, Artificial Sequence
  synthetic sequence
gacttcttgacag

SEQ ID NO: 10501 - DNA, 13 bp, Artificial Sequence
  synthetic sequence
ttggtttaacccc

SEQ ID NO: 10502 - DNA, 13 bp, Artificial Sequence
  synthetic sequence
ctcttggaagtcc

SEQ ID NO: 10503 - DNA, 13 bp, Artificial Sequence
  synthetic sequence
gattggtcagatt

SEQ ID NO: 10504 - DNA, 13 bp, Artificial Sequence
  synthetic sequence
gaatgtgtggtgg

SEQ ID NO: 10505 - DNA, 13 bp, Artificial Sequence
  synthetic sequence
aaaccattcaacg

SEQ ID NO: 10506 - DNA, 13 bp, Artificial Sequence
  synthetic sequence
ttcacgctttctg

SEQ ID NO: 10507 - DNA, 13 bp, Artificial Sequence
  synthetic sequence
taggctaatactt

SEQ ID NO: 10508 - DNA, 13 bp, Artificial Sequence
  synthetic sequence
aggagtctaaatt

SEQ ID NO: 10509 - DNA, 13 bp, Artificial Sequence
  synthetic sequence
gaggtactcaggg

SEQ ID NO: 10510 - DNA, 13 bp, Artificial Sequence
  synthetic sequence
tttggccttaaat

SEQ ID NO: 10511 - DNA, 13 bp, Artificial Sequence
  synthetic sequence
ttggagatgattc

SEQ ID NO: 10512 - DNA, 13 bp, Artificial Sequence
  synthetic sequence
atgatggaaaatt

SEQ ID NO: 10513 - DNA, 13 bp, Artificial Sequence
  synthetic sequence
catttgtgacctt

SEQ ID NO: 10514 - DNA, 13 bp, Artificial Sequence
  synthetic sequence
cctgcttcatttt

SEQ ID NO: 10515 - DNA, 13 bp, Artificial Sequence
  synthetic sequence
aaaacgcttttta

SEQ ID NO: 10516 - DNA, 13 bp, Artificial Sequence
  synthetic sequence
tgatccaatggct

SEQ ID NO: 10517 - DNA, 13 bp, Artificial Sequence
  synthetic sequence
atccaaagaaaat

SEQ ID NO: 10518 - DNA, 13 bp, Artificial Sequence
  synthetic sequence
caggtgttgctat

SEQ ID NO: 10519 - DNA, 13 bp, Artificial Sequence
  synthetic sequence
ttcaaattggtca

SEQ ID NO: 10520 - DNA, 13 bp, Artificial Sequence
  synthetic sequence
cagattgcaaatt

SEQ ID NO: 10521 - DNA, 13 bp, Artificial Sequence
  synthetic sequence
aatcttcagttca

SEQ ID NO: 10522 - DNA, 13 bp, Artificial Sequence
  synthetic sequence
ttagcaaagaaag

SEQ ID NO: 10523 - DNA, 13 bp, Artificial Sequence
  synthetic sequence
aatcaaaaacaag

SEQ ID NO: 10524 - DNA, 13 bp, Artificial Sequence
  synthetic sequence
actacacatgctc

SEQ ID NO: 10525 - DNA, 13 bp, Artificial Sequence
  synthetic sequence
gaccacatcctgt

SEQ ID NO: 10526 - DNA, 13 bp, Artificial Sequence
  synthetic sequence
ccatggtattctt

SEQ ID NO: 10527 - DNA, 13 bp, Artificial Sequence
  synthetic sequence
gagagtcatatag

SEQ ID NO: 10528 - DNA, 13 bp, Artificial Sequence
  synthetic sequence
actcaagaaatgt

SEQ ID NO: 10529 - DNA, 13 bp, Artificial Sequence
  synthetic sequence
ttgttcagtcctg

SEQ ID NO: 10530 - DNA, 13 bp, Artificial Sequence
  synthetic sequence
acaagtgggttgc

SEQ ID NO: 10531 - DNA, 13 bp, Artificial Sequence
  synthetic sequence
ataaaggttccat

SEQ ID NO: 10532 - DNA, 13 bp, Artificial Sequence
  synthetic sequence
attctattgctgg

SEQ ID NO: 10533 - DNA, 13 bp, Artificial Sequence
  synthetic sequence
tggttcctggtga

SEQ ID NO: 10534 - DNA, 13 bp, Artificial Sequence
  synthetic sequence
gtgagccagttgt

SEQ ID NO: 10535 - DNA, 13 bp, Artificial Sequence
  synthetic sequence
ttgatgctagtct

SEQ ID NO: 10536 - DNA, 13 bp, Artificial Sequence
  synthetic sequence
tggagttgtggtc

SEQ ID NO: 10537 - DNA, 13 bp, Artificial Sequence
  synthetic sequence
tattatgtgtttt

SEQ ID NO: 10538 - DNA, 13 bp, Artificial Sequence
  synthetic sequence
tatgcaagatttg

SEQ ID NO: 10539 - DNA, 13 bp, Artificial Sequence
  synthetic sequence
gatttcgtgttcc

SEQ ID NO: 10540 - DNA, 13 bp, Artificial Sequence
  synthetic sequence
tcatttgtcacct

SEQ ID NO: 10541 - DNA, 13 bp, Artificial Sequence
  synthetic sequence
taatggatggaca

SEQ ID NO: 10542 - DNA, 13 bp, Artificial Sequence
  synthetic sequence
tctcagtcaactt

SEQ ID NO: 10543 - DNA, 13 bp, Artificial Sequence
  synthetic sequence
tttagagatatta

SEQ ID NO: 10544 - DNA, 13 bp, Artificial Sequence
  synthetic sequence
aaataataaagag

SEQ ID NO: 10545 - DNA, 13 bp, Artificial Sequence
  synthetic sequence
gaaatgaatttag

SEQ ID NO: 10546 - DNA, 13 bp, Artificial Sequence
  synthetic sequence
actcagttagttg

SEQ ID NO: 10547 - DNA, 13 bp, Artificial Sequence
  synthetic sequence
atgttgttattca

SEQ ID NO: 10548 - DNA, 13 bp, Artificial Sequence
  synthetic sequence
aaagagatttaat

SEQ ID NO: 10549 - DNA, 13 bp, Artificial Sequence
  synthetic sequence
ggcaagaagaagg

SEQ ID NO: 10550 - DNA, 13 bp, Artificial Sequence
  synthetic sequence
tcttatcaatact

SEQ ID NO: 10551 - DNA, 13 bp, Artificial Sequence
  synthetic sequence
gcattttgcaaat

SEQ ID NO: 10552 - DNA, 13 bp, Artificial Sequence
  synthetic sequence
taatttctgaggg

SEQ ID NO: 10553 - DNA, 13 bp, Artificial Sequence
  synthetic sequence
atgaattatgcag

SEQ ID NO: 10554 - DNA, 13 bp, Artificial Sequence
  synthetic sequence
ttgtcaaatgaag

SEQ ID NO: 10555 - DNA, 13 bp, Artificial Sequence
  synthetic sequence
ttaagagtggaat

SEQ ID NO: 10556 - DNA, 13 bp, Artificial Sequence
  synthetic sequence
gttcactccagta

SEQ ID NO: 10557 - DNA, 13 bp, Artificial Sequence
  synthetic sequence
acaatttggtctt

SEQ ID NO: 10558 - DNA, 13 bp, Artificial Sequence
  synthetic sequence
ataacaaccatga

SEQ ID NO: 10559 - DNA, 13 bp, Artificial Sequence
  synthetic sequence
tatggtgttgaac

SEQ ID NO: 10560 - DNA, 13 bp, Artificial Sequence
  synthetic sequence
agatgttactgga

SEQ ID NO: 10561 - DNA, 13 bp, Artificial Sequence
  synthetic sequence
tgacttctccttc

SEQ ID NO: 10562 - DNA, 13 bp, Artificial Sequence
  synthetic sequence
agattgaatgatg

SEQ ID NO: 10563 - DNA, 13 bp, Artificial Sequence
  synthetic sequence
taccttctcatgc

SEQ ID NO: 10564 - DNA, 13 bp, Artificial Sequence
  synthetic sequence
agagctccattaa

SEQ ID NO: 10565 - DNA, 13 bp, Artificial Sequence
  synthetic sequence
atgttcaaattga

SEQ ID NO: 10566 - DNA, 13 bp, Artificial Sequence
  synthetic sequence
tcttggagaggag

SEQ ID NO: 10567 - DNA, 13 bp, Artificial Sequence
  synthetic sequence
acaaatattggtc

SEQ ID NO: 10568 - DNA, 13 bp, Artificial Sequence
  synthetic sequence
attggaacaggaa

SEQ ID NO: 10569 - DNA, 13 bp, Artificial Sequence
  synthetic sequence
agttgtatagagg

SEQ ID NO: 10570 - DNA, 13 bp, Artificial Sequence
  synthetic sequence
actcattttacta

SEQ ID NO: 10571 - DNA, 13 bp, Artificial Sequence
  synthetic sequence
aaaatgtgcctca

SEQ ID NO: 10572 - DNA, 13 bp, Artificial Sequence
  synthetic sequence
tgagaactcagag

SEQ ID NO: 10573 - DNA, 13 bp, Artificial Sequence
  synthetic sequence
cattaaggtggtt

SEQ ID NO: 10574 - DNA, 13 bp, Artificial Sequence
  synthetic sequence
caaggtggtggaa

SEQ ID NO: 10575 - DNA, 13 bp, Artificial Sequence
  synthetic sequence
tggttaagagata

SEQ ID NO: 10576 - DNA, 13 bp, Artificial Sequence
  synthetic sequence
ttttccacatgga

SEQ ID NO: 10577 - DNA, 13 bp, Artificial Sequence
  synthetic sequence
tattttcccagag

SEQ ID NO: 10578 - DNA, 13 bp, Artificial Sequence
  synthetic sequence
tttcctggagagg

SEQ ID NO: 10579 - DNA, 13 bp, Artificial Sequence
  synthetic sequence
tagatgtttctgg

SEQ ID NO: 10580 - DNA, 13 bp, Artificial Sequence
  synthetic sequence
cttatacttcact

SEQ ID NO: 10581 - DNA, 13 bp, Artificial Sequence
  synthetic sequence
aatgtacctcagc

SEQ ID NO: 10582 - DNA, 13 bp, Artificial Sequence
  synthetic sequence
atgttcagattga

SEQ ID NO: 10583 - DNA, 13 bp, Artificial Sequence
  synthetic sequence
tgaaagatgattg

SEQ ID NO: 10584 - DNA, 13 bp, Artificial Sequence
  synthetic sequence
gtgtattgttata

SEQ ID NO: 10585 - DNA, 13 bp, Artificial Sequence
  synthetic sequence
agcctgaaaagaa

SEQ ID NO: 10586 - DNA, 13 bp, Artificial Sequence
  synthetic sequence
aaagggaaagcca

SEQ ID NO: 10587 - DNA, 13 bp, Artificial Sequence
  synthetic sequence
ttcagttatttca

SEQ ID NO: 10588 - DNA, 13 bp, Artificial Sequence
  synthetic sequence
ctgcaatttcaga

SEQ ID NO: 10589 - DNA, 13 bp, Artificial Sequence
  synthetic sequence
cctggtttactcc

SEQ ID NO: 10590 - DNA, 13 bp, Artificial Sequence
  synthetic sequence
gggtttccttatg

SEQ ID NO: 10591 - DNA, 13 bp, Artificial Sequence
  synthetic sequence
aaatggaggaaaa

SEQ ID NO: 10592 - DNA, 13 bp, Artificial Sequence
  synthetic sequence
gatttttatgaag

SEQ ID NO: 10593 - DNA, 13 bp, Artificial Sequence
  synthetic sequence
atttgctgtacaa

SEQ ID NO: 10594 - DNA, 13 bp, Artificial Sequence
  synthetic sequence
ctaggaaaatgaa

SEQ ID NO: 10595 - DNA, 13 bp, Artificial Sequence
  synthetic sequence
tcaagagtggaat

SEQ ID NO: 10596 - DNA, 13 bp, Artificial Sequence
  synthetic sequence
cattttattaaga

SEQ ID NO: 10597 - DNA, 13 bp, Artificial Sequence
  synthetic sequence
tactattcaattt

SEQ ID NO: 10598 - DNA, 13 bp, Artificial Sequence
  synthetic sequence
aattcaaacaata

SEQ ID NO: 10599 - DNA, 13 bp, Artificial Sequence
  synthetic sequence
tttctagatcttg

SEQ ID NO: 10600 - DNA, 13 bp, Artificial Sequence
  synthetic sequence
gttccttggattt

SEQ ID NO: 10601 - DNA, 13 bp, Artificial Sequence
  synthetic sequence
gttgaccctaacc

SEQ ID NO: 10602 - DNA, 13 bp, Artificial Sequence
  synthetic sequence
ggattagttagga

SEQ ID NO: 10603 - DNA, 13 bp, Artificial Sequence
  synthetic sequence
gagttagtactac

SEQ ID NO: 10604 - DNA, 13 bp, Artificial Sequence
  synthetic sequence
aagcagacaattt

SEQ ID NO: 10605 - DNA, 13 bp, Artificial Sequence
  synthetic sequence
atcttgttttcga

SEQ ID NO: 10606 - DNA, 13 bp, Artificial Sequence
  synthetic sequence
gcttttgatgcca

SEQ ID NO: 10607 - DNA, 13 bp, Artificial Sequence
  synthetic sequence
aaagaggaagaac

SEQ ID NO: 10608 - DNA, 13 bp, Artificial Sequence
  synthetic sequence
caacagatgagga

SEQ ID NO: 10609 - DNA, 13 bp, Artificial Sequence
  synthetic sequence
agccagtttcaga

SEQ ID NO: 10610 - DNA, 13 bp, Artificial Sequence
  synthetic sequence
cttgtgttgattt

SEQ ID NO: 10611 - DNA, 13 bp, Artificial Sequence
  synthetic sequence
ggagttttccgga

SEQ ID NO: 10612 - DNA, 13 bp, Artificial Sequence
  synthetic sequence
gtactttgttttg

SEQ ID NO: 10613 - DNA, 13 bp, Artificial Sequence
  synthetic sequence
atagaatgtagga

SEQ ID NO: 10614 - DNA, 13 bp, Artificial Sequence
  synthetic sequence
gttgagataccat

SEQ ID NO: 10615 - DNA, 13 bp, Artificial Sequence
  synthetic sequence
aatccaagatgtg

SEQ ID NO: 10616 - DNA, 13 bp, Artificial Sequence
  synthetic sequence
agttttatcagaa

SEQ ID NO: 10617 - DNA, 13 bp, Artificial Sequence
  synthetic sequence
tcaattcttgtgg

SEQ ID NO: 10618 - DNA, 13 bp, Artificial Sequence
  synthetic sequence
tatactagaggtg

SEQ ID NO: 10619 - DNA, 13 bp, Artificial Sequence
  synthetic sequence
cagttgtttgcta

SEQ ID NO: 10620 - DNA, 13 bp, Artificial Sequence
  synthetic sequence
gggaatttcagat

SEQ ID NO: 10621 - DNA, 13 bp, Artificial Sequence
  synthetic sequence
gaccaaagttatg

SEQ ID NO: 10622 - DNA, 13 bp, Artificial Sequence
  synthetic sequence
gatagcagagtgc

SEQ ID NO: 10623 - DNA, 13 bp, Artificial Sequence
  synthetic sequence
gactgaatgatga

SEQ ID NO: 10624 - DNA, 13 bp, Artificial Sequence
  synthetic sequence
tttttccaatctg

SEQ ID NO: 10625 - DNA, 13 bp, Artificial Sequence
  synthetic sequence
ttcacactgctga

SEQ ID NO: 10626 - DNA, 13 bp, Artificial Sequence
  synthetic sequence
aacctcagaaatt

SEQ ID NO: 10627 - DNA, 13 bp, Artificial Sequence
  synthetic sequence
agccaagttaaca

SEQ ID NO: 10628 - DNA, 13 bp, Artificial Sequence
  synthetic sequence
tccaccaatcata

SEQ ID NO: 10629 - DNA, 13 bp, Artificial Sequence
  synthetic sequence
cagctgcaattct

SEQ ID NO: 10630 - DNA, 13 bp, Artificial Sequence
  synthetic sequence
ccacatccaattt

SEQ ID NO: 10631 - DNA, 13 bp, Artificial Sequence
  synthetic sequence
ctgactttcaatt

SEQ ID NO: 10632 - DNA, 13 bp, Artificial Sequence
  synthetic sequence
tttatctgaactt

SEQ ID NO: 10633 - DNA, 13 bp, Artificial Sequence
  synthetic sequence
tggagactttcca

SEQ ID NO: 10634 - DNA, 13 bp, Artificial Sequence
  synthetic sequence
tccacacacttct

SEQ ID NO: 10635 - DNA, 13 bp, Artificial Sequence
  synthetic sequence
ctgcaggaaaatt

SEQ ID NO: 10636 - DNA, 13 bp, Artificial Sequence
  synthetic sequence
cctgaatgatatt

SEQ ID NO: 10637 - DNA, 13 bp, Artificial Sequence
  synthetic sequence
ctcacacatccat

SEQ ID NO: 10638 - DNA, 13 bp, Artificial Sequence
  synthetic sequence
atggttcaccaga

SEQ ID NO: 10639 - DNA, 13 bp, Artificial Sequence
  synthetic sequence
caaaccactgagc

SEQ ID NO: 10640 - DNA, 13 bp, Artificial Sequence
  synthetic sequence
aagaacagtccag

SEQ ID NO: 10641 - DNA, 13 bp, Artificial Sequence
  synthetic sequence
tcatttcataatc

SEQ ID NO: 10642 - DNA, 13 bp, Artificial Sequence
  synthetic sequence
ctcccaacagtct

SEQ ID NO: 10643 - DNA, 13 bp, Artificial Sequence
  synthetic sequence
tcaccaatatccg

SEQ ID NO: 10644 - DNA, 13 bp, Artificial Sequence
  synthetic sequence
tcaagaccaacat

SEQ ID NO: 10645 - DNA, 13 bp, Artificial Sequence
  synthetic sequence
catttctgtccat

SEQ ID NO: 10646 - DNA, 13 bp, Artificial Sequence
  synthetic sequence
aaactgttgttga

SEQ ID NO: 10647 - DNA, 13 bp, Artificial Sequence
  synthetic sequence
ccagtcactgcag

SEQ ID NO: 10648 - DNA, 13 bp, Artificial Sequence
  synthetic sequence
acagaatgatgaa

SEQ ID NO: 10649 - DNA, 13 bp, Artificial Sequence
  synthetic sequence
ccatgaggaggat

SEQ ID NO: 10650 - DNA, 13 bp, Artificial Sequence
  synthetic sequence
tccaagcattcta

SEQ ID NO: 10651 - DNA, 13 bp, Artificial Sequence
  synthetic sequence
cctttctgatact

SEQ ID NO: 10652 - DNA, 13 bp, Artificial Sequence
  synthetic sequence
tgaaagataaaca

SEQ ID NO: 10653 - DNA, 13 bp, Artificial Sequence
  synthetic sequence
tagctcccacagg

SEQ ID NO: 10654 - DNA, 13 bp, Artificial Sequence
  synthetic sequence
tttcatccaacca

SEQ ID NO: 10655 - DNA, 13 bp, Artificial Sequence
  synthetic sequence
aattcccaaactg

SEQ ID NO: 10656 - DNA, 13 bp, Artificial Sequence
  synthetic sequence
ctgatgtatgtct

SEQ ID NO: 10657 - DNA, 13 bp, Artificial Sequence
  synthetic sequence
ctccatgcctgat

SEQ ID NO: 10658 - DNA, 13 bp, Artificial Sequence
  synthetic sequence
catcatttgtttt

SEQ ID NO: 10659 - DNA, 13 bp, Artificial Sequence
  synthetic sequence
tttatagatccaa

SEQ ID NO: 10660 - DNA, 13 bp, Artificial Sequence
  synthetic sequence
cctgaacctgcag

SEQ ID NO: 10661 - DNA, 13 bp, Artificial Sequence
  synthetic sequence
gcactcctgtaat

SEQ ID NO: 10662 - DNA, 13 bp, Artificial Sequence
  synthetic sequence
acataaactgttt

SEQ ID NO: 10663 - DNA, 13 bp, Artificial Sequence
  synthetic sequence
ttgagtctttgtt

SEQ ID NO: 10664 - DNA, 13 bp, Artificial Sequence
  synthetic sequence
catccagtgctcc

SEQ ID NO: 10665 - DNA, 13 bp, Artificial Sequence
  synthetic sequence
gaaaataactaat

SEQ ID NO: 10666 - DNA, 13 bp, Artificial Sequence
  synthetic sequence
agacagccctgac

SEQ ID NO: 10667 - DNA, 13 bp, Artificial Sequence
  synthetic sequence
catcctgacacta

SEQ ID NO: 10668 - DNA, 13 bp, Artificial Sequence
  synthetic sequence
catgctcctcagt

SEQ ID NO: 10669 - DNA, 13 bp, Artificial Sequence
  synthetic sequence
ccatttgccaatt

SEQ ID NO: 10670 - DNA, 13 bp, Artificial Sequence
  synthetic sequence
catgaggataaac

SEQ ID NO: 10671 - DNA, 13 bp, Artificial Sequence
  synthetic sequence
aaagcaaaagaca

SEQ ID NO: 10672 - DNA, 13 bp, Artificial Sequence
  synthetic sequence
gaaagaggagtta

SEQ ID NO: 10673 - DNA, 13 bp, Artificial Sequence
  synthetic sequence
gcactccaagaat

SEQ ID NO: 10674 - DNA, 13 bp, Artificial Sequence
  synthetic sequence
agtgtactcacct

SEQ ID NO: 10675 - DNA, 13 bp, Artificial Sequence
  synthetic sequence
atttcaactgtca

SEQ ID NO: 10676 - DNA, 13 bp, Artificial Sequence
  synthetic sequence
ttatacatttttg

SEQ ID NO: 10677 - DNA, 13 bp, Artificial Sequence
  synthetic sequence
attgcattctgta

SEQ ID NO: 10678 - DNA, 13 bp, Artificial Sequence
  synthetic sequence
aaattttggttgc

SEQ ID NO: 10679 - DNA, 13 bp, Artificial Sequence
  synthetic sequence
tggcagcaatttc

SEQ ID NO: 10680 - DNA, 13 bp, Artificial Sequence
  synthetic sequence
caatagacaaagc

SEQ ID NO: 10681 - DNA, 13 bp, Artificial Sequence
  synthetic sequence
ataataattgtca

SEQ ID NO: 10682 - DNA, 13 bp, Artificial Sequence
  synthetic sequence
gaattgtaggaac

SEQ ID NO: 10683 - DNA, 13 bp, Artificial Sequence
  synthetic sequence
acagttgtcacta

SEQ ID NO: 10684 - DNA, 13 bp, Artificial Sequence
  synthetic sequence
ggcattgaaccac

SEQ ID NO: 10685 - DNA, 13 bp, Artificial Sequence
  synthetic sequence
ctgattgttctgt

SEQ ID NO: 10686 - DNA, 13 bp, Artificial Sequence
  synthetic sequence
acaaaccaattat

SEQ ID NO: 10687 - DNA, 13 bp, Artificial Sequence
  synthetic sequence
ctttctctaatgg

SEQ ID NO: 10688 - DNA, 13 bp, Artificial Sequence
  synthetic sequence
ctgtaatggccat

SEQ ID NO: 10689 - DNA, 13 bp, Artificial Sequence
  synthetic sequence
tcactcatgattc

SEQ ID NO: 10690 - DNA, 13 bp, Artificial Sequence
  synthetic sequence
tatatggcatcct

SEQ ID NO: 10691 - DNA, 13 bp, Artificial Sequence
  synthetic sequence
tccaatcaaatca

SEQ ID NO: 10692 - DNA, 13 bp, Artificial Sequence
  synthetic sequence
ctttaagaatatt

SEQ ID NO: 10693 - DNA, 13 bp, Artificial Sequence
  synthetic sequence
gtttatcaacaga

SEQ ID NO: 10694 - DNA, 13 bp, Artificial Sequence
  synthetic sequence
cctctggttcttc

SEQ ID NO: 10695 - DNA, 13 bp, Artificial Sequence
  synthetic sequence
taaccatcccaat

SEQ ID NO: 10696 - DNA, 13 bp, Artificial Sequence
  synthetic sequence
atcttttaagaaa

SEQ ID NO: 10697 - DNA, 13 bp, Artificial Sequence
  synthetic sequence
ttaatcacctgtt

SEQ ID NO: 10698 - DNA, 13 bp, Artificial Sequence
  synthetic sequence
aagcattaaatgg

SEQ ID NO: 10699 - DNA, 13 bp, Artificial Sequence
  synthetic sequence
gctaaggttggaa

SEQ ID NO: 10700 - DNA, 13 bp, Artificial Sequence
  synthetic sequence
tgagaaaagtcaa

SEQ ID NO: 10701 - DNA, 13 bp, Artificial Sequence
  synthetic sequence
tccactatatcca

SEQ ID NO: 10702 - DNA, 13 bp, Artificial Sequence
  synthetic sequence
tcttagaaccagg

SEQ ID NO: 10703 - DNA, 13 bp, Artificial Sequence
  synthetic sequence
catccttgaagtt

SEQ ID NO: 10704 - DNA, 13 bp, Artificial Sequence
  synthetic sequence
gcttagttacacc

SEQ ID NO: 10705 - DNA, 13 bp, Artificial Sequence
  synthetic sequence
atggctttttcta

SEQ ID NO: 10706 - DNA, 13 bp, Artificial Sequence
  synthetic sequence
actcatccacaat

SEQ ID NO: 10707 - DNA, 13 bp, Artificial Sequence
  synthetic sequence
atggtgttccaga

SEQ ID NO: 10708 - DNA, 13 bp, Artificial Sequence
  synthetic sequence
ctgaagcttcttt

SEQ ID NO: 10709 - DNA, 13 bp, Artificial Sequence
  synthetic sequence
gccaagcgattca

SEQ ID NO: 10710 - DNA, 13 bp, Artificial Sequence
  synthetic sequence
taaaggacaaata

SEQ ID NO: 10711 - DNA, 13 bp, Artificial Sequence
  synthetic sequence
caaagctgtacaa

SEQ ID NO: 10712 - DNA, 13 bp, Artificial Sequence
  synthetic sequence
caattcatctttt

SEQ ID NO: 10713 - DNA, 13 bp, Artificial Sequence
  synthetic sequence
ctcaacagaccaa

SEQ ID NO: 10714 - DNA, 13 bp, Artificial Sequence
  synthetic sequence
tgggaattgtggg

SEQ ID NO: 10715 - DNA, 13 bp, Artificial Sequence
  synthetic sequence
ctgcatccaattt

SEQ ID NO: 10716 - DNA, 13 bp, Artificial Sequence
  synthetic sequence
tcttcctgatcca

SEQ ID NO: 10717 - DNA, 13 bp, Artificial Sequence
  synthetic sequence
attagtgtttgtc

SEQ ID NO: 10718 - DNA, 13 bp, Artificial Sequence
  synthetic sequence
ctttttgatgtgc

SEQ ID NO: 10719 - DNA, 13 bp, Artificial Sequence
  synthetic sequence
caacatgaatacc

SEQ ID NO: 10720 - DNA, 13 bp, Artificial Sequence
  synthetic sequence
accatcctcccac

SEQ ID NO: 10721 - DNA, 13 bp, Artificial Sequence
  synthetic sequence
ttggaaaatcttt

SEQ ID NO: 10722 - DNA, 13 bp, Artificial Sequence
  synthetic sequence
tcatctgtgtaga

SEQ ID NO: 10723 - DNA, 13 bp, Artificial Sequence
  synthetic sequence
cagtggctcctgt

SEQ ID NO: 10724 - DNA, 13 bp, Artificial Sequence
  synthetic sequence
taacagctccaag

SEQ ID NO: 10725 - DNA, 13 bp, Artificial Sequence
  synthetic sequence
gccaatgcaattg

SEQ ID NO: 10726 - DNA, 13 bp, Artificial Sequence
  synthetic sequence
ctaactacattat

SEQ ID NO: 10727 - DNA, 13 bp, Artificial Sequence
  synthetic sequence
aacattttggaaa

SEQ ID NO: 10728 - DNA, 13 bp, Artificial Sequence
  synthetic sequence
gcttgtgaaaata

SEQ ID NO: 10729 - DNA, 13 bp, Artificial Sequence
  synthetic sequence
taatagctggacc

SEQ ID NO: 10730 - DNA, 13 bp, Artificial Sequence
  synthetic sequence
ctgcacaaggagc

SEQ ID NO: 10731 - DNA, 13 bp, Artificial Sequence
  synthetic sequence
cttccttaacata

SEQ ID NO: 10732 - DNA, 13 bp, Artificial Sequence
  synthetic sequence
acagaaatagaca

SEQ ID NO: 10733 - DNA, 13 bp, Artificial Sequence
  synthetic sequence
aaaattgaagcct

SEQ ID NO: 10734 - DNA, 13 bp, Artificial Sequence
  synthetic sequence
caatctcaattct

SEQ ID NO: 10735 - DNA, 13 bp, Artificial Sequence
  synthetic sequence
cagacacggcata

SEQ ID NO: 10736 - DNA, 13 bp, Artificial Sequence
  synthetic sequence
aggtttttaagtt

SEQ ID NO: 10737 - DNA, 13 bp, Artificial Sequence
  synthetic sequence
gccaatcttggat

SEQ ID NO: 10738 - DNA, 13 bp, Artificial Sequence
  synthetic sequence
cagctaaagttgg

SEQ ID NO: 10739 - DNA, 13 bp, Artificial Sequence
  synthetic sequence
actgtcatcacta

SEQ ID NO: 10740 - DNA, 13 bp, Artificial Sequence
  synthetic sequence
taattctgtcctc

SEQ ID NO: 10741 - DNA, 13 bp, Artificial Sequence
  synthetic sequence
aactcatctacaa

SEQ ID NO: 10742 - DNA, 13 bp, Artificial Sequence
  synthetic sequence
caatggctttctc

SEQ ID NO: 10743 - DNA, 13 bp, Artificial Sequence
  synthetic sequence
gccatattcaatc

SEQ ID NO: 10744 - DNA, 13 bp, Artificial Sequence
  synthetic sequence
cttgcactcctga

SEQ ID NO: 10745 - DNA, 13 bp, Artificial Sequence
  synthetic sequence
agacatatgatct

SEQ ID NO: 10746 - DNA, 13 bp, Artificial Sequence
  synthetic sequence
ttctaatatcaac

SEQ ID NO: 10747 - DNA, 13 bp, Artificial Sequence
  synthetic sequence
ggaattaagccta

SEQ ID NO: 10748 - DNA, 13 bp, Artificial Sequence
  synthetic sequence
atgtgagagtgct

SEQ ID NO: 10749 - DNA, 13 bp, Artificial Sequence
  synthetic sequence
aacattaactcta

SEQ ID NO: 10750 - DNA, 13 bp, Artificial Sequence
  synthetic sequence
tctgaccaaactc

SEQ ID NO: 10751 - DNA, 13 bp, Artificial Sequence
  synthetic sequence
atatttacaaaca

SEQ ID NO: 10752 - DNA, 13 bp, Artificial Sequence
  synthetic sequence
tccatgcctggtc

SEQ ID NO: 10753 - DNA, 13 bp, Artificial Sequence
  synthetic sequence
ggtctgggattaa

SEQ ID NO: 10754 - DNA, 13 bp, Artificial Sequence
  synthetic sequence
tttaatttcctgc

SEQ ID NO: 10755 - DNA, 13 bp, Artificial Sequence
  synthetic sequence
tatgtggtcgatg

SEQ ID NO: 10756 - DNA, 13 bp, Artificial Sequence
  synthetic sequence
attcatccaacca

SEQ ID NO: 10757 - DNA, 13 bp, Artificial Sequence
  synthetic sequence
cagtcccagcgcc

SEQ ID NO: 10758 - DNA, 13 bp, Artificial Sequence
  synthetic sequence
tgcctatgctgcc

SEQ ID NO: 10759 - DNA, 13 bp, Artificial Sequence
  synthetic sequence
gaatgaataacat

SEQ ID NO: 10760 - DNA, 13 bp, Artificial Sequence
  synthetic sequence
gaatgctgtggtg

SEQ ID NO: 10761 - DNA, 13 bp, Artificial Sequence
  synthetic sequence
aaccttattggca

SEQ ID NO: 10762 - DNA, 13 bp, Artificial Sequence
  synthetic sequence
cccgggagtctta

SEQ ID NO: 10763 - DNA, 13 bp, Artificial Sequence
  synthetic sequence
gaggctaataagc

SEQ ID NO: 10764 - DNA, 13 bp, Artificial Sequence
  synthetic sequence
acttttgatgatt

SEQ ID NO: 10765 - DNA, 13 bp, Artificial Sequence
  synthetic sequence
gaattgatttcgt

SEQ ID NO: 10766 - DNA, 13 bp, Artificial Sequence
  synthetic sequence
gtgagcgccttca

SEQ ID NO: 10767 - DNA, 13 bp, Artificial Sequence
  synthetic sequence
tcagcctgctcta

SEQ ID NO: 10768 - DNA, 13 bp, Artificial Sequence
  synthetic sequence
atgacctttggcc

SEQ ID NO: 10769 - DNA, 13 bp, Artificial Sequence
  synthetic sequence
ttgagcagaaccc

SEQ ID NO: 10770 - DNA, 13 bp, Artificial Sequence
  synthetic sequence
tcatacgcggggc

SEQ ID NO: 10771 - DNA, 13 bp, Artificial Sequence
  synthetic sequence
atagccacggccg

SEQ ID NO: 10772 - DNA, 13 bp, Artificial Sequence
  synthetic sequence
gttgaggccatgg

SEQ ID NO: 10773 - DNA, 13 bp, Artificial Sequence
  synthetic sequence
tagtccactgccg

SEQ ID NO: 10774 - DNA, 13 bp, Artificial Sequence
  synthetic sequence
gtttgtgatttcc

SEQ ID NO: 10775 - DNA, 13 bp, Artificial Sequence
  synthetic sequence
ataagaccttccg

SEQ ID NO: 10776 - DNA, 13 bp, Artificial Sequence
  synthetic sequence
gatgattcagtgg

SEQ ID NO: 10777 - DNA, 13 bp, Artificial Sequence
  synthetic sequence
accaaccctatgt

SEQ ID NO: 10778 - DNA, 13 bp, Artificial Sequence
  synthetic sequence
tgtgccggctgca

SEQ ID NO: 10779 - DNA, 13 bp, Artificial Sequence
  synthetic sequence
atcagatccctgc

SEQ ID NO: 10780 - DNA, 13 bp, Artificial Sequence
  synthetic sequence
tgtccgtgagtcc

SEQ ID NO: 10781 - DNA, 13 bp, Artificial Sequence
  synthetic sequence
tccagcgggttat

SEQ ID NO: 10782 - DNA, 13 bp, Artificial Sequence
  synthetic sequence
aaggtgtatgcag

SEQ ID NO: 10783 - DNA, 13 bp, Artificial Sequence
  synthetic sequence
cccttgattggtc

SEQ ID NO: 10784 - DNA, 13 bp, Artificial Sequence
  synthetic sequence
gtttttacgcagg

SEQ ID NO: 10785 - DNA, 13 bp, Artificial Sequence
  synthetic sequence
ctaatacacctta

SEQ ID NO: 10786 - DNA, 13 bp, Artificial Sequence
  synthetic sequence
accaggtccctgt

SEQ ID NO: 10787 - DNA, 13 bp, Artificial Sequence
  synthetic sequence
ctggtgagactat

SEQ ID NO: 10788 - DNA, 13 bp, Artificial Sequence
  synthetic sequence
taccagcacagcc

SEQ ID NO: 10789 - DNA, 13 bp, Artificial Sequence
  synthetic sequence
gcccctgtacctg

SEQ ID NO: 10790 - DNA, 13 bp, Artificial Sequence
  synthetic sequence
tctgaggtcgacc

SEQ ID NO: 10791 - DNA, 13 bp, Artificial Sequence
  synthetic sequence
accacccggcacc

SEQ ID NO: 10792 - DNA, 13 bp, Artificial Sequence
  synthetic sequence
tgcagtgatcact

SEQ ID NO: 10793 - DNA, 13 bp, Artificial Sequence
  synthetic sequence
ttttgggaggctg

SEQ ID NO: 10794 - DNA, 13 bp, Artificial Sequence
  synthetic sequence
tgccgacggtggc

SEQ ID NO: 10795 - DNA, 13 bp, Artificial Sequence
  synthetic sequence
aatgataacccca

SEQ ID NO: 10796 - DNA, 13 bp, Artificial Sequence
  synthetic sequence
gcccctagcgccg

SEQ ID NO: 10797 - DNA, 13 bp, Artificial Sequence
  synthetic sequence
gttgtgattgatg

SEQ ID NO: 10798 - DNA, 13 bp, Artificial Sequence
  synthetic sequence
tggaacatggcga

SEQ ID NO: 10799 - DNA, 13 bp, Artificial Sequence
  synthetic sequence
gtaaattctgctg

SEQ ID NO: 10800 - DNA, 13 bp, Artificial Sequence
  synthetic sequence
tggttgtgcccac

SEQ ID NO: 10801 - DNA, 13 bp, Artificial Sequence
  synthetic sequence
agtctatgggggc

SEQ ID NO: 10802 - DNA, 13 bp, Artificial Sequence
  synthetic sequence
gccctctataggg

SEQ ID NO: 10803 - DNA, 13 bp, Artificial Sequence
  synthetic sequence
ccgtcacctgccc

SEQ ID NO: 10804 - DNA, 13 bp, Artificial Sequence
  synthetic sequence
gtgcgggctataa

SEQ ID NO: 10805 - DNA, 13 bp, Artificial Sequence
  synthetic sequence
tggttccgtgcca

SEQ ID NO: 10806 - DNA, 13 bp, Artificial Sequence
  synthetic sequence
gagaatgcgcagc

SEQ ID NO: 10807 - DNA, 13 bp, Artificial Sequence
  synthetic sequence
ttgaaaatgactt

SEQ ID NO: 10808 - DNA, 13 bp, Artificial Sequence
  synthetic sequence
tttggtgccaccc

SEQ ID NO: 10809 - DNA, 13 bp, Artificial Sequence
  synthetic sequence
gacccctgggaac

SEQ ID NO: 10810 - DNA, 13 bp, Artificial Sequence
  synthetic sequence
cagccacacgttt

SEQ ID NO: 10811 - DNA, 13 bp, Artificial Sequence
  synthetic sequence
gcatgccccaatg

SEQ ID NO: 10812 - DNA, 13 bp, Artificial Sequence
  synthetic sequence
aggggactttgta

SEQ ID NO: 10813 - DNA, 13 bp, Artificial Sequence
  synthetic sequence
agaacctcgggac

SEQ ID NO: 10814 - DNA, 13 bp, Artificial Sequence
  synthetic sequence
aatgcacagcagg

SEQ ID NO: 10815 - DNA, 13 bp, Artificial Sequence
  synthetic sequence
agtatggtttttg

SEQ ID NO: 10816 - DNA, 13 bp, Artificial Sequence
  synthetic sequence
ggctgtatgctgg

SEQ ID NO: 10817 - DNA, 13 bp, Artificial Sequence
  synthetic sequence
tctgatataattg

SEQ ID NO: 10818 - DNA, 13 bp, Artificial Sequence
  synthetic sequence
tcgctgaccggtg

SEQ ID NO: 10819 - DNA, 13 bp, Artificial Sequence
  synthetic sequence
tctcttgattggt

SEQ ID NO: 10820 - DNA, 13 bp, Artificial Sequence
  synthetic sequence
tctgaggtggacc

SEQ ID NO: 10821 - DNA, 13 bp, Artificial Sequence
  synthetic sequence
tatgaagcggccc

SEQ ID NO: 10822 - DNA, 13 bp, Artificial Sequence
  synthetic sequence
tatatagagcgct

SEQ ID NO: 10823 - DNA, 13 bp, Artificial Sequence
  synthetic sequence
cttactgcagccc

SEQ ID NO: 10824 - DNA, 13 bp, Artificial Sequence
  synthetic sequence
ggaacaccgtttg

SEQ ID NO: 10825 - DNA, 13 bp, Artificial Sequence
  synthetic sequence
ggggatgttgatg

SEQ ID NO: 10826 - DNA, 13 bp, Artificial Sequence
  synthetic sequence
gccggccctgtgt

SEQ ID NO: 10827 - DNA, 13 bp, Artificial Sequence
  synthetic sequence
cccctgttaattc

SEQ ID NO: 10828 - DNA, 13 bp, Artificial Sequence
  synthetic sequence
gctgtgattactg

SEQ ID NO: 10829 - DNA, 13 bp, Artificial Sequence
  synthetic sequence
ccacctacactac

SEQ ID NO: 10830 - DNA, 13 bp, Artificial Sequence
  synthetic sequence
tgttaccacctgg

SEQ ID NO: 10831 - DNA, 13 bp, Artificial Sequence
  synthetic sequence
tgccccctgtcga

SEQ ID NO: 10832 - DNA, 13 bp, Artificial Sequence
  synthetic sequence
cgcggcaacccag

SEQ ID NO: 10833 - DNA, 13 bp, Artificial Sequence
  synthetic sequence
ttaatgacaaccc

SEQ ID NO: 10834 - DNA, 13 bp, Artificial Sequence
  synthetic sequence
tttggtgccacct

SEQ ID NO: 10835 - DNA, 13 bp, Artificial Sequence
  synthetic sequence
ggcgtctaattac

SEQ ID NO: 10836 - DNA, 13 bp, Artificial Sequence
  synthetic sequence
tctggaactaatc

SEQ ID NO: 10837 - DNA, 13 bp, Artificial Sequence
  synthetic sequence
atgggggctgggc

SEQ ID NO: 10838 - DNA, 13 bp, Artificial Sequence
  synthetic sequence
gagccgcaatgcg

SEQ ID NO: 10839 - DNA, 13 bp, Artificial Sequence
  synthetic sequence
taggtttgtatgc

SEQ ID NO: 10840 - DNA, 13 bp, Artificial Sequence
  synthetic sequence
cgttttatccgac

SEQ ID NO: 10841 - DNA, 13 bp, Artificial Sequence
  synthetic sequence
cttcgtgcatgga

SEQ ID NO: 10842 - DNA, 13 bp, Artificial Sequence
  synthetic sequence
ccaatcctatgta

SEQ ID NO: 10843 - DNA, 13 bp, Artificial Sequence
  synthetic sequence
ccacacgatttat

SEQ ID NO: 10844 - DNA, 13 bp, Artificial Sequence
  synthetic sequence
ttaattaggttgt

SEQ ID NO: 10845 - DNA, 13 bp, Artificial Sequence
  synthetic sequence
accgggtcgttcg

SEQ ID NO: 10846 - DNA, 13 bp, Artificial Sequence
  synthetic sequence
acttggtccacat

SEQ ID NO: 10847 - DNA, 13 bp, Artificial Sequence
  synthetic sequence
cagtaagaggtat

SEQ ID NO: 10848 - DNA, 13 bp, Artificial Sequence
  synthetic sequence
attatccctagca

SEQ ID NO: 10849 - DNA, 13 bp, Artificial Sequence
  synthetic sequence
gtggtgatagatg

SEQ ID NO: 10850 - DNA, 13 bp, Artificial Sequence
  synthetic sequence
gttctctacgctg

SEQ ID NO: 10851 - DNA, 13 bp, Artificial Sequence
  synthetic sequence
gctcaccgcggcc

SEQ ID NO: 10852 - DNA, 13 bp, Artificial Sequence
  synthetic sequence
agactacaactac

SEQ ID NO: 10853 - DNA, 13 bp, Artificial Sequence
  synthetic sequence
cagcgccattcgc

SEQ ID NO: 10854 - DNA, 13 bp, Artificial Sequence
  synthetic sequence
cggcctgctgcgt

SEQ ID NO: 10855 - DNA, 13 bp, Artificial Sequence
  synthetic sequence
accagattcctgc

SEQ ID NO: 10856 - DNA, 13 bp, Artificial Sequence
  synthetic sequence
gactaaggctggc

SEQ ID NO: 10857 - DNA, 13 bp, Artificial Sequence
  synthetic sequence
cggtgcttgggaa

SEQ ID NO: 10858 - DNA, 13 bp, Artificial Sequence
  synthetic sequence
ccagcgcctgata

SEQ ID NO: 10859 - DNA, 13 bp, Artificial Sequence
  synthetic sequence
gctctcggctggc

SEQ ID NO: 10860 - DNA, 13 bp, Artificial Sequence
  synthetic sequence
gtatggccgcccc

SEQ ID NO: 10861 - DNA, 13 bp, Artificial Sequence
  synthetic sequence
gaccggcctaccc

SEQ ID NO: 10862 - DNA, 13 bp, Artificial Sequence
  synthetic sequence
ctggtggggcgcc

SEQ ID NO: 10863 - DNA, 13 bp, Artificial Sequence
  synthetic sequence
tgcgcctagcagt

SEQ ID NO: 10864 - DNA, 13 bp, Artificial Sequence
  synthetic sequence
ggcccctgtcgcc

SEQ ID NO: 10865 - DNA, 13 bp, Artificial Sequence
  synthetic sequence
ttgcgcgaggtcg

SEQ ID NO: 10866 - DNA, 13 bp, Artificial Sequence
  synthetic sequence
tgtcgcttcgggt

SEQ ID NO: 10867 - DNA, 13 bp, Artificial Sequence
  synthetic sequence
ctactggggtcag

SEQ ID NO: 10868 - DNA, 13 bp, Artificial Sequence
  synthetic sequence
ccagcgagtcata

SEQ ID NO: 10869 - DNA, 13 bp, Artificial Sequence
  synthetic sequence
gccatgcttttta

SEQ ID NO: 10870 - DNA, 13 bp, Artificial Sequence
  synthetic sequence
catgccccagtgg

SEQ ID NO: 10871 - DNA, 13 bp, Artificial Sequence
  synthetic sequence
gtgctgctgctca

SEQ ID NO: 10872 - DNA, 13 bp, Artificial Sequence
  synthetic sequence
ctatcggccagaa

SEQ ID NO: 10873 - DNA, 13 bp, Artificial Sequence
  synthetic sequence
ttggccctactcc

SEQ ID NO: 10874 - DNA, 13 bp, Artificial Sequence
  synthetic sequence
acctataccacta

SEQ ID NO: 10875 - DNA, 13 bp, Artificial Sequence
  synthetic sequence
ctattaaccccgg

SEQ ID NO: 10876 - DNA, 13 bp, Artificial Sequence
  synthetic sequence
aaaggcatgcgtc

SEQ ID NO: 10877 - DNA, 13 bp, Artificial Sequence
  synthetic sequence
caaggtgtatgcg

SEQ ID NO: 10878 - DNA, 13 bp, Artificial Sequence
  synthetic sequence
ctgacatggggtt

SEQ ID NO: 10879 - DNA, 13 bp, Artificial Sequence
  synthetic sequence
ccccgtccgcgag

SEQ ID NO: 10880 - DNA, 13 bp, Artificial Sequence
  synthetic sequence
catgcattttacc

SEQ ID NO: 10881 - DNA, 13 bp, Artificial Sequence
  synthetic sequence
attatgcccagta

SEQ ID NO: 10882 - DNA, 13 bp, Artificial Sequence
  synthetic sequence
gagctcatacgtg

SEQ ID NO: 10883 - DNA, 13 bp, Artificial Sequence
  synthetic sequence
gctatatgctgga

SEQ ID NO: 10884 - DNA, 13 bp, Artificial Sequence
  synthetic sequence
accctctgttcct

SEQ ID NO: 10885 - DNA, 13 bp, Artificial Sequence
  synthetic sequence
ctcccgactatag

SEQ ID NO: 10886 - DNA, 13 bp, Artificial Sequence
  synthetic sequence
gctgacaggcgga

SEQ ID NO: 10887 - DNA, 13 bp, Artificial Sequence
  synthetic sequence
tggttttcacgca

SEQ ID NO: 10888 - DNA, 13 bp, Artificial Sequence
  synthetic sequence
gtggcaaccctga

SEQ ID NO: 10889 - DNA, 13 bp, Artificial Sequence
  synthetic sequence
ggtagagaagggt

SEQ ID NO: 10890 - DNA, 13 bp, Artificial Sequence
  synthetic sequence
tgtcgccgctccg

SEQ ID NO: 10891 - DNA, 13 bp, Artificial Sequence
  synthetic sequence
ttttgctgcttta

SEQ ID NO: 10892 - DNA, 13 bp, Artificial Sequence
  synthetic sequence
attgagaaggaga

SEQ ID NO: 10893 - DNA, 13 bp, Artificial Sequence
  synthetic sequence
gctccagttttat

SEQ ID NO: 10894 - DNA, 13 bp, Artificial Sequence
  synthetic sequence
gatgttgattctc

SEQ ID NO: 10895 - DNA, 13 bp, Artificial Sequence
  synthetic sequence
cccatggtaaggt

SEQ ID NO: 10896 - DNA, 13 bp, Artificial Sequence
  synthetic sequence
atcagcctgctcc

SEQ ID NO: 10897 - DNA, 13 bp, Artificial Sequence
  synthetic sequence
cactaccgcaatc

SEQ ID NO: 10898 - DNA, 13 bp, Artificial Sequence
  synthetic sequence
tggtctacatctg

SEQ ID NO: 10899 - DNA, 13 bp, Artificial Sequence
  synthetic sequence
tcttattcaatct

SEQ ID NO: 10900 - DNA, 13 bp, Artificial Sequence
  synthetic sequence
atttcaccgggac

SEQ ID NO: 10901 - DNA, 13 bp, Artificial Sequence
  synthetic sequence
gggttaccctcgg

SEQ ID NO: 10902 - DNA, 13 bp, Artificial Sequence
  synthetic sequence
tgccgacagaatt

SEQ ID NO: 10903 - DNA, 13 bp, Artificial Sequence
  synthetic sequence
ccgagcctgctgg

SEQ ID NO: 10904 - DNA, 13 bp, Artificial Sequence
  synthetic sequence
tcccacctaatat

SEQ ID NO: 10905 - DNA, 13 bp, Artificial Sequence
  synthetic sequence
agggagcgcggaa

SEQ ID NO: 10906 - DNA, 13 bp, Artificial Sequence
  synthetic sequence
ggcgcagccccag

SEQ ID NO: 10907 - DNA, 13 bp, Artificial Sequence
  synthetic sequence
acacgggacacaa

SEQ ID NO: 10908 - DNA, 13 bp, Artificial Sequence
  synthetic sequence
ggctcgccattgg

SEQ ID NO: 10909 - DNA, 13 bp, Artificial Sequence
  synthetic sequence
tgcgccgcccacg

SEQ ID NO: 10910 - DNA, 13 bp, Artificial Sequence
  synthetic sequence
cactgactcctca

SEQ ID NO: 10911 - DNA, 13 bp, Artificial Sequence
  synthetic sequence
cactcctccataa

SEQ ID NO: 10912 - DNA, 13 bp, Artificial Sequence
  synthetic sequence
taaccacacggga

SEQ ID NO: 10913 - DNA, 13 bp, Artificial Sequence
  synthetic sequence
gttgaacgagggt

SEQ ID NO: 10914 - DNA, 13 bp, Artificial Sequence
  synthetic sequence
gcattcggcacca

SEQ ID NO: 10915 - DNA, 13 bp, Artificial Sequence
  synthetic sequence
aaatcctaacatc

SEQ ID NO: 10916 - DNA, 13 bp, Artificial Sequence
  synthetic sequence
cggggttgcatca

SEQ ID NO: 10917 - DNA, 13 bp, Artificial Sequence
  synthetic sequence
gggccccaattct

SEQ ID NO: 10918 - DNA, 13 bp, Artificial Sequence
  synthetic sequence
tatcagcaagatt

SEQ ID NO: 10919 - DNA, 13 bp, Artificial Sequence
  synthetic sequence
ctcctcctcagcc

SEQ ID NO: 10920 - DNA, 13 bp, Artificial Sequence
  synthetic sequence
atgcttcttccag

SEQ ID NO: 10921 - DNA, 13 bp, Artificial Sequence
  synthetic sequence
catgtggtggcct

SEQ ID NO: 10922 - DNA, 13 bp, Artificial Sequence
  synthetic sequence
cgcgagacatcac

SEQ ID NO: 10923 - DNA, 13 bp, Artificial Sequence
  synthetic sequence
ccgtcgtgaatca

SEQ ID NO: 10924 - DNA, 13 bp, Artificial Sequence
  synthetic sequence
tcaaccttcaatt

SEQ ID NO: 10925 - DNA, 13 bp, Artificial Sequence
  synthetic sequence
gcattctcaatca

SEQ ID NO: 10926 - DNA, 13 bp, Artificial Sequence
  synthetic sequence
tccagccccggat

SEQ ID NO: 10927 - DNA, 13 bp, Artificial Sequence
  synthetic sequence
ccggggatgtaat

SEQ ID NO: 10928 - DNA, 13 bp, Artificial Sequence
  synthetic sequence
caccaactatttt

SEQ ID NO: 10929 - DNA, 13 bp, Artificial Sequence
  synthetic sequence
tcccatgggcgat

SEQ ID NO: 10930 - DNA, 13 bp, Artificial Sequence
  synthetic sequence
cataaaatgtctt

SEQ ID NO: 10931 - DNA, 13 bp, Artificial Sequence
  synthetic sequence
tagcgctgatggc

SEQ ID NO: 10932 - DNA, 13 bp, Artificial Sequence
  synthetic sequence
agtgcaaaatcaa

SEQ ID NO: 10933 - DNA, 13 bp, Artificial Sequence
  synthetic sequence
gacaaattatact

SEQ ID NO: 10934 - DNA, 13 bp, Artificial Sequence
  synthetic sequence
agatgggcgccat

SEQ ID NO: 10935 - DNA, 13 bp, Artificial Sequence
  synthetic sequence
gggtgagctcata

SEQ ID NO: 10936 - DNA, 13 bp, Artificial Sequence
  synthetic sequence
cccagatatggac

SEQ ID NO: 10937 - DNA, 13 bp, Artificial Sequence
  synthetic sequence
gccacattaacaa

SEQ ID NO: 10938 - DNA, 13 bp, Artificial Sequence
  synthetic sequence
taaagtgggcctt

SEQ ID NO: 10939 - DNA, 13 bp, Artificial Sequence
  synthetic sequence
cgtgtcatcccat

SEQ ID NO: 10940 - DNA, 13 bp, Artificial Sequence
  synthetic sequence
tcggctggctcca

SEQ ID NO: 10941 - DNA, 13 bp, Artificial Sequence
  synthetic sequence
ctctaatgccagg

SEQ ID NO: 10942 - DNA, 13 bp, Artificial Sequence
  synthetic sequence
acgacgggagcaa

SEQ ID NO: 10943 - DNA, 13 bp, Artificial Sequence
  synthetic sequence
tgcccaggggaga

SEQ ID NO: 10944 - DNA, 13 bp, Artificial Sequence
  synthetic sequence
tgatagtgcacaa

SEQ ID NO: 10945 - DNA, 13 bp, Artificial Sequence
  synthetic sequence
cgaaggactgaga

SEQ ID NO: 10946 - DNA, 13 bp, Artificial Sequence
  synthetic sequence
gcagcaaaagcac

SEQ ID NO: 10947 - DNA, 13 bp, Artificial Sequence
  synthetic sequence
cccggcagtactg

SEQ ID NO: 10948 - DNA, 13 bp, Artificial Sequence
  synthetic sequence
aatcgcaccaggg

SEQ ID NO: 10949 - DNA, 13 bp, Artificial Sequence
  synthetic sequence
ccgaggaggcccg

SEQ ID NO: 10950 - DNA, 13 bp, Artificial Sequence
  synthetic sequence
gccaccagctcgt

SEQ ID NO: 10951 - DNA, 13 bp, Artificial Sequence
  synthetic sequence
ctgattcatcaaa

SEQ ID NO: 10952 - DNA, 13 bp, Artificial Sequence
  synthetic sequence
cagcctttcgctg

SEQ ID NO: 10953 - DNA, 13 bp, Artificial Sequence
  synthetic sequence
actggaatgcaca

SEQ ID NO: 10954 - DNA, 13 bp, Artificial Sequence
  synthetic sequence
tgtgtgaggtgtg

SEQ ID NO: 10955 - DNA, 13 bp, Artificial Sequence
  synthetic sequence
ctccaggccgata

SEQ ID NO: 10956 - DNA, 13 bp, Artificial Sequence
  synthetic sequence
tagggcgcggggt

SEQ ID NO: 10957 - DNA, 13 bp, Artificial Sequence
  synthetic sequence
ggctcgtggtctg

SEQ ID NO: 10958 - DNA, 13 bp, Artificial Sequence
  synthetic sequence
cggccgcctcagg

SEQ ID NO: 10959 - DNA, 13 bp, Artificial Sequence
  synthetic sequence
cgttcccaggcat

SEQ ID NO: 10960 - DNA, 13 bp, Artificial Sequence
  synthetic sequence
acagtagccgtta

SEQ ID NO: 10961 - DNA, 13 bp, Artificial Sequence
  synthetic sequence
tgccaccaactag

SEQ ID NO: 10962 - DNA, 13 bp, Artificial Sequence
  synthetic sequence
tcccatcagcacc

SEQ ID NO: 10963 - DNA, 13 bp, Artificial Sequence
  synthetic sequence
gatggccgacctc

SEQ ID NO: 10964 - DNA, 13 bp, Artificial Sequence
  synthetic sequence
agcaatgtgctat

SEQ ID NO: 10965 - DNA, 13 bp, Artificial Sequence
  synthetic sequence
taataccacggag

SEQ ID NO: 10966 - DNA, 13 bp, Artificial Sequence
  synthetic sequence
tcaagcacagcta

SEQ ID NO: 10967 - DNA, 13 bp, Artificial Sequence
  synthetic sequence
gctcttgtggcat

SEQ ID NO: 10968 - DNA, 13 bp, Artificial Sequence
  synthetic sequence
tggtgccatcctg

SEQ ID NO: 10969 - DNA, 13 bp, Artificial Sequence
  synthetic sequence
cacgggtgggggc

SEQ ID NO: 10970 - DNA, 13 bp, Artificial Sequence
  synthetic sequence
gggcggtggtaac

SEQ ID NO: 10971 - DNA, 13 bp, Artificial Sequence
  synthetic sequence
atagcatgggccc

SEQ ID NO: 10972 - DNA, 13 bp, Artificial Sequence
  synthetic sequence
tgaacctattgta

SEQ ID NO: 10973 - DNA, 13 bp, Artificial Sequence
  synthetic sequence
aggcgcagcggga

SEQ ID NO: 10974 - DNA, 13 bp, Artificial Sequence
  synthetic sequence
tcctcagccaact

SEQ ID NO: 10975 - DNA, 13 bp, Artificial Sequence
  synthetic sequence
gaaacatcaagat

SEQ ID NO: 10976 - DNA, 13 bp, Artificial Sequence
  synthetic sequence
ttacgctcccagg

SEQ ID NO: 10977 - DNA, 13 bp, Artificial Sequence
  synthetic sequence
gcagtgtgctatg

SEQ ID NO: 10978 - DNA, 13 bp, Artificial Sequence
  synthetic sequence
ggctgccacctcc

SEQ ID NO: 10979 - DNA, 13 bp, Artificial Sequence
  synthetic sequence
cgtacctgccgac

SEQ ID NO: 10980 - DNA, 13 bp, Artificial Sequence
  synthetic sequence
tagactggaaagc

SEQ ID NO: 10981 - DNA, 13 bp, Artificial Sequence
  synthetic sequence
ggggagaagtcgc

SEQ ID NO: 10982 - DNA, 13 bp, Artificial Sequence
  synthetic sequence
gacccctcagagg

SEQ ID NO: 10983 - DNA, 13 bp, Artificial Sequence
  synthetic sequence
tggcgacaagtgc

SEQ ID NO: 10984 - DNA, 13 bp, Artificial Sequence
  synthetic sequence
tagagtaacccct

SEQ ID NO: 10985 - DNA, 13 bp, Artificial Sequence
  synthetic sequence
tctcaagcgcaag

SEQ ID NO: 10986 - DNA, 13 bp, Artificial Sequence
  synthetic sequence
ccaggccttccgc

SEQ ID NO: 10987 - DNA, 13 bp, Artificial Sequence
  synthetic sequence
gggagcaggtctc

SEQ ID NO: 10988 - DNA, 13 bp, Artificial Sequence
  synthetic sequence
gacaagttcatac

SEQ ID NO: 10989 - DNA, 13 bp, Artificial Sequence
  synthetic sequence
gccacattgacaa

SEQ ID NO: 10990 - DNA, 13 bp, Artificial Sequence
  synthetic sequence
actccaagccgaa

SEQ ID NO: 10991 - DNA, 13 bp, Artificial Sequence
  synthetic sequence
ccggggagaaagg

SEQ ID NO: 10992 - DNA, 13 bp, Artificial Sequence
  synthetic sequence
ggcgagtaagtgc

SEQ ID NO: 10993 - DNA, 13 bp, Artificial Sequence
  synthetic sequence
gtcccatcggcac

SEQ ID NO: 10994 - DNA, 13 bp, Artificial Sequence
  synthetic sequence
gaggctcgctgca

SEQ ID NO: 10995 - DNA, 13 bp, Artificial Sequence
  synthetic sequence
ccagctggtggta

SEQ ID NO: 10996 - DNA, 13 bp, Artificial Sequence
  synthetic sequence
tagatgcattaac

SEQ ID NO: 10997 - DNA, 13 bp, Artificial Sequence
  synthetic sequence
gaataccagcgct

SEQ ID NO: 10998 - DNA, 13 bp, Artificial Sequence
  synthetic sequence
gggctaatacacc

SEQ ID NO: 10999 - DNA, 13 bp, Artificial Sequence
  synthetic sequence
tctcagtaaaatg

SEQ ID NO: 11000 - DNA, 13 bp, Artificial Sequence
  synthetic sequence
aggcgggggtgtt

SEQ ID NO: 11001 - DNA, 13 bp, Artificial Sequence
  synthetic sequence
gcgggctcaaagt

SEQ ID NO: 11002 - DNA, 13 bp, Artificial Sequence
  synthetic sequence
cgttaaccagcca

SEQ ID NO: 11003 - DNA, 13 bp, Artificial Sequence
  synthetic sequence
cagagacatcaag

SEQ ID NO: 11004 - DNA, 13 bp, Artificial Sequence
  synthetic sequence
tggagggcagcat

SEQ ID NO: 11005 - DNA, 13 bp, Artificial Sequence
  synthetic sequence
ggcaggggaccgc

SEQ ID NO: 11006 - DNA, 13 bp, Artificial Sequence
  synthetic sequence
tcttgttgcgggg

SEQ ID NO: 11007 - DNA, 13 bp, Artificial Sequence
  synthetic sequence
cccagcaggcacg

SEQ ID NO: 11008 - DNA, 13 bp, Artificial Sequence
  synthetic sequence
agaacagccctag

SEQ ID NO: 11009 - DNA, 13 bp, Artificial Sequence
  synthetic sequence
cacggctggtcgt

SEQ ID NO: 11010 - DNA, 13 bp, Artificial Sequence
  synthetic sequence
accccggcggtga

SEQ ID NO: 11011 - DNA, 13 bp, Artificial Sequence
  synthetic sequence
tcaagctcgagtg

SEQ ID NO: 11012 - DNA, 13 bp, Artificial Sequence
  synthetic sequence
agtattggtgccg

SEQ ID NO: 11013 - DNA, 13 bp, Artificial Sequence
  synthetic sequence
atgtagtcacggc

SEQ ID NO: 11014 - DNA, 13 bp, Artificial Sequence
  synthetic sequence
aacggtaattgcg

SEQ ID NO: 11015 - DNA, 13 bp, Artificial Sequence
  synthetic sequence
agaagggggcaca

SEQ ID NO: 11016 - DNA, 13 bp, Artificial Sequence
  synthetic sequence
ggcggtggtggcc

SEQ ID NO: 11017 - DNA, 13 bp, Artificial Sequence
  synthetic sequence
taatcaaccttca

SEQ ID NO: 11018 - DNA, 13 bp, Artificial Sequence
  synthetic sequence
gtagtatgaccag

SEQ ID NO: 11019 - DNA, 13 bp, Artificial Sequence
  synthetic sequence
agactccttcggc

SEQ ID NO: 11020 - DNA, 13 bp, Artificial Sequence
  synthetic sequence
ccacacccgatgt

SEQ ID NO: 11021 - DNA, 13 bp, Artificial Sequence
  synthetic sequence
taacgctgatggc

SEQ ID NO: 11022 - DNA, 13 bp, Artificial Sequence
  synthetic sequence
cgtactgctcagg

SEQ ID NO: 11023 - DNA, 13 bp, Artificial Sequence
  synthetic sequence
tgaaccgggacag

SEQ ID NO: 11024 - DNA, 13 bp, Artificial Sequence
  synthetic sequence
tataaaggagccg

SEQ ID NO: 11025 - DNA, 13 bp, Artificial Sequence
  synthetic sequence
gccccgggttgtg

SEQ ID NO: 11026 - DNA, 13 bp, Artificial Sequence
  synthetic sequence
cacaaaacatcat

SEQ ID NO: 11027 - DNA, 13 bp, Artificial Sequence
  synthetic sequence
cgccaactgttgc

SEQ ID NO: 11028 - DNA, 13 bp, Artificial Sequence
  synthetic sequence
ggcgatggtggcc

SEQ ID NO: 11029 - DNA, 13 bp, Artificial Sequence
  synthetic sequence
tcacatgtggtag

SEQ ID NO: 11030 - DNA, 13 bp, Artificial Sequence
  synthetic sequence
agacgtgacgcac

SEQ ID NO: 11031 - DNA, 13 bp, Artificial Sequence
  synthetic sequence
cgtcacgattgca

SEQ ID NO: 11032 - DNA, 13 bp, Artificial Sequence
  synthetic sequence
cgaggttgcatca

SEQ ID NO: 11033 - DNA, 13 bp, Artificial Sequence
  synthetic sequence
tggtgtggacggc

SEQ ID NO: 11034 - DNA, 13 bp, Artificial Sequence
  synthetic sequence
cggcgagtgcggg

SEQ ID NO: 11035 - DNA, 13 bp, Artificial Sequence
  synthetic sequence
gaccggctgcatt

SEQ ID NO: 11036 - DNA, 13 bp, Artificial Sequence
  synthetic sequence
gatggccagggtt

SEQ ID NO: 11037 - DNA, 13 bp, Artificial Sequence
  synthetic sequence
gttgccatcgtga

SEQ ID NO: 11038 - DNA, 13 bp, Artificial Sequence
  synthetic sequence
cgtgagcggggac

SEQ ID NO: 11039 - DNA, 13 bp, Artificial Sequence
  synthetic sequence
tgcaggctcagct

SEQ ID NO: 11040 - DNA, 13 bp, Artificial Sequence
  synthetic sequence
tcctggagaggca

SEQ ID NO: 11041 - DNA, 13 bp, Artificial Sequence
  synthetic sequence
acgctatcggaca

SEQ ID NO: 11042 - DNA, 13 bp, Artificial Sequence
  synthetic sequence
gacagatagtcaa

SEQ ID NO: 11043 - DNA, 13 bp, Artificial Sequence
  synthetic sequence
cagagtgtggagc

SEQ ID NO: 11044 - DNA, 13 bp, Artificial Sequence
  synthetic sequence
gcgggtgatcacc

SEQ ID NO: 11045 - DNA, 13 bp, Artificial Sequence
  synthetic sequence
tatcagcgagatt

SEQ ID NO: 11046 - DNA, 13 bp, Artificial Sequence
  synthetic sequence
taaaatgtcttgg

SEQ ID NO: 11047 - DNA, 13 bp, Artificial Sequence
  synthetic sequence
gccgtcaggcgtg

SEQ ID NO: 11048 - DNA, 13 bp, Artificial Sequence
  synthetic sequence
ctcataagtcacg

SEQ ID NO: 11049 - DNA, 13 bp, Artificial Sequence
  synthetic sequence
tatgccaggctgg

SEQ ID NO: 11050 - DNA, 13 bp, Artificial Sequence
  synthetic sequence
ttggctcgaagga

SEQ ID NO: 11051 - DNA, 13 bp, Artificial Sequence
  synthetic sequence
gattatactgacg

SEQ ID NO: 11052 - DNA, 13 bp, Artificial Sequence
  synthetic sequence
cggccagcgcgag

SEQ ID NO: 11053 - DNA, 13 bp, Artificial Sequence
  synthetic sequence
ggccccagttctt

SEQ ID NO: 11054 - DNA, 13 bp, Artificial Sequence
  synthetic sequence
gcttactaaccgg

SEQ ID NO: 11055 - DNA, 13 bp, Artificial Sequence
  synthetic sequence
atagaatgtctta

SEQ ID NO: 11056 - DNA, 13 bp, Artificial Sequence
  synthetic sequence
tgtggggtgtgaa

SEQ ID NO: 11057 - DNA, 13 bp, Artificial Sequence
  synthetic sequence
ctagacttcccgg

SEQ ID NO: 11058 - DNA, 13 bp, Artificial Sequence
  synthetic sequence
gcatttggcacca

SEQ ID NO: 11059 - DNA, 13 bp, Artificial Sequence
  synthetic sequence
catactgctcagg

SEQ ID NO: 11060 - DNA, 13 bp, Artificial Sequence
  synthetic sequence
agccggtcccaga

SEQ ID NO: 11061 - DNA, 13 bp, Artificial Sequence
  synthetic sequence
agatctatgtcat

SEQ ID NO: 11062 - DNA, 13 bp, Artificial Sequence
  synthetic sequence
acgctgccaccct

SEQ ID NO: 11063 - DNA, 13 bp, Artificial Sequence
  synthetic sequence
gccatccacgccg

SEQ ID NO: 11064 - DNA, 13 bp, Artificial Sequence
  synthetic sequence
gaccgggcctttg

SEQ ID NO: 11065 - DNA, 13 bp, Artificial Sequence
  synthetic sequence
tttctgttctgcg

SEQ ID NO: 11066 - DNA, 13 bp, Artificial Sequence
  synthetic sequence
tctgcccagtgga

SEQ ID NO: 11067 - DNA, 13 bp, Artificial Sequence
  synthetic sequence
cagtccttccgat

SEQ ID NO: 11068 - DNA, 13 bp, Artificial Sequence
  synthetic sequence
ggctgccagaagg

SEQ ID NO: 11069 - DNA, 13 bp, Artificial Sequence
  synthetic sequence
tcttcctttcata

SEQ ID NO: 11070 - DNA, 13 bp, Artificial Sequence
  synthetic sequence
agaccaccaacac

SEQ ID NO: 11071 - DNA, 13 bp, Artificial Sequence
  synthetic sequence
acggcgctcctgc

SEQ ID NO: 11072 - DNA, 13 bp, Artificial Sequence
  synthetic sequence
ctcctcataccac

SEQ ID NO: 11073 - DNA, 13 bp, Artificial Sequence
  synthetic sequence
ttccctaggcaat

SEQ ID NO: 11074 - DNA, 13 bp, Artificial Sequence
  synthetic sequence
cgccttccaactg

SEQ ID NO: 11075 - DNA, 13 bp, Artificial Sequence
  synthetic sequence
tccctcctagcca

SEQ ID NO: 11076 - DNA, 13 bp, Artificial Sequence
  synthetic sequence
ggatgacattctc

SEQ ID NO: 11077 - DNA, 13 bp, Artificial Sequence
  synthetic sequence
ggcctctatcctc

SEQ ID NO: 11078 - DNA, 13 bp, Artificial Sequence
  synthetic sequence
gaggctattattc

SEQ ID NO: 11079 - DNA, 13 bp, Artificial Sequence
  synthetic sequence
gtccttaccccgc

SEQ ID NO: 11080 - DNA, 13 bp, Artificial Sequence
  synthetic sequence
cagctacgacacc

SEQ ID NO: 11081 - DNA, 13 bp, Artificial Sequence
  synthetic sequence
gggggaggtttaa

SEQ ID NO: 11082 - DNA, 13 bp, Artificial Sequence
  synthetic sequence
ttccagccctact

SEQ ID NO: 11083 - DNA, 13 bp, Artificial Sequence
  synthetic sequence
ggcgctacctgaa

SEQ ID NO: 11084 - DNA, 13 bp, Artificial Sequence
  synthetic sequence
ctggaagcgagac

SEQ ID NO: 11085 - DNA, 13 bp, Artificial Sequence
  synthetic sequence
tggcctctcacag

SEQ ID NO: 11086 - DNA, 13 bp, Artificial Sequence
  synthetic sequence
tggtgccccatct

SEQ ID NO: 11087 - DNA, 13 bp, Artificial Sequence
  synthetic sequence
ctaattcccatgt

SEQ ID NO: 11088 - DNA, 13 bp, Artificial Sequence
  synthetic sequence
tatttcaagcttc

SEQ ID NO: 11089 - DNA, 13 bp, Artificial Sequence
  synthetic sequence
atgcgtttccccg

SEQ ID NO: 11090 - DNA, 13 bp, Artificial Sequence
  synthetic sequence
acgtcctatactc

SEQ ID NO: 11091 - DNA, 13 bp, Artificial Sequence
  synthetic sequence
cctcctgcagtac

SEQ ID NO: 11092 - DNA, 13 bp, Artificial Sequence
  synthetic sequence
ccagccatcttta

SEQ ID NO: 11093 - DNA, 13 bp, Artificial Sequence
  synthetic sequence
acccatttcaaat

SEQ ID NO: 11094 - DNA, 13 bp, Artificial Sequence
  synthetic sequence
ctataaaatttcc

SEQ ID NO: 11095 - DNA, 13 bp, Artificial Sequence
  synthetic sequence
ttattatcagccc

SEQ ID NO: 11096 - DNA, 13 bp, Artificial Sequence
  synthetic sequence
ctaggggctatta

SEQ ID NO: 11097 - DNA, 13 bp, Artificial Sequence
  synthetic sequence
atagccctctagg

SEQ ID NO: 11098 - DNA, 13 bp, Artificial Sequence
  synthetic sequence
tcccaagacttcc

SEQ ID NO: 11099 - DNA, 13 bp, Artificial Sequence
  synthetic sequence
aacatatttctag

SEQ ID NO: 11100 - DNA, 13 bp, Artificial Sequence
  synthetic sequence
gaacccacccttg

SEQ ID NO: 11101 - DNA, 13 bp, Artificial Sequence
  synthetic sequence
agttacgatttcc

SEQ ID NO: 11102 - DNA, 13 bp, Artificial Sequence
  synthetic sequence
aatcaaccacctg

SEQ ID NO: 11103 - DNA, 13 bp, Artificial Sequence
  synthetic sequence
ctttccggacaac

SEQ ID NO: 11104 - DNA, 13 bp, Artificial Sequence
  synthetic sequence
tcagaagctattt

SEQ ID NO: 11105 - DNA, 13 bp, Artificial Sequence
  synthetic sequence
tgtcacctgttcc

SEQ ID NO: 11106 - DNA, 13 bp, Artificial Sequence
  synthetic sequence
ctagccagtgccc

SEQ ID NO: 11107 - DNA, 13 bp, Artificial Sequence
  synthetic sequence
ctcccctgccaat

SEQ ID NO: 11108 - DNA, 13 bp, Artificial Sequence
  synthetic sequence
atgtccctcgcct

SEQ ID NO: 11109 - DNA, 13 bp, Artificial Sequence
  synthetic sequence
cccagtttatgca

SEQ ID NO: 11110 - DNA, 13 bp, Artificial Sequence
  synthetic sequence
gcttactatcgcg

SEQ ID NO: 11111 - DNA, 13 bp, Artificial Sequence
  synthetic sequence
gaccaaatatatt

SEQ ID NO: 11112 - DNA, 13 bp, Artificial Sequence
  synthetic sequence
gagccccaaatat

SEQ ID NO: 11113 - DNA, 13 bp, Artificial Sequence
  synthetic sequence
ccgattcaaaaat

SEQ ID NO: 11114 - DNA, 13 bp, Artificial Sequence
  synthetic sequence
ccatggaaatcaa

SEQ ID NO: 11115 - DNA, 13 bp, Artificial Sequence
  synthetic sequence
atggcacgcatat

SEQ ID NO: 11116 - DNA, 13 bp, Artificial Sequence
  synthetic sequence
ttccggtgcggga

SEQ ID NO: 11117 - DNA, 13 bp, Artificial Sequence
  synthetic sequence
gatgtcaatttta

SEQ ID NO: 11118 - DNA, 13 bp, Artificial Sequence
  synthetic sequence
ttccgccaccgca

SEQ ID NO: 11119 - DNA, 13 bp, Artificial Sequence
  synthetic sequence
gctctctcctgca

SEQ ID NO: 11120 - DNA, 13 bp, Artificial Sequence
  synthetic sequence
tcacctgggaccc

SEQ ID NO: 11121 - DNA, 13 bp, Artificial Sequence
  synthetic sequence
tcaaaaaccacaa

SEQ ID NO: 11122 - DNA, 13 bp, Artificial Sequence
  synthetic sequence
ttaaaccagaacg

SEQ ID NO: 11123 - DNA, 13 bp, Artificial Sequence
  synthetic sequence
tggacccactgct

SEQ ID NO: 11124 - DNA, 13 bp, Artificial Sequence
  synthetic sequence
tcccaccctgttc

SEQ ID NO: 11125 - DNA, 13 bp, Artificial Sequence
  synthetic sequence
caacaatccacaa

SEQ ID NO: 11126 - DNA, 13 bp, Artificial Sequence
  synthetic sequence
tctgccaaaccat

SEQ ID NO: 11127 - DNA, 13 bp, Artificial Sequence
  synthetic sequence
gtacctccctgag

SEQ ID NO: 11128 - DNA, 13 bp, Artificial Sequence
  synthetic sequence
atggcattcttaa

SEQ ID NO: 11129 - DNA, 13 bp, Artificial Sequence
  synthetic sequence
gacctccgggaag

SEQ ID NO: 11130 - DNA, 13 bp, Artificial Sequence
  synthetic sequence
cataaacaccgcc

SEQ ID NO: 11131 - DNA, 13 bp, Artificial Sequence
  synthetic sequence
tggcaaaacggcc

SEQ ID NO: 11132 - DNA, 13 bp, Artificial Sequence
  synthetic sequence
aattaagttccta

SEQ ID NO: 11133 - DNA, 13 bp, Artificial Sequence
  synthetic sequence
gtcggcccgtaat

SEQ ID NO: 11134 - DNA, 13 bp, Artificial Sequence
  synthetic sequence
tcccagttaaaaa

SEQ ID NO: 11135 - DNA, 13 bp, Artificial Sequence
  synthetic sequence
actcttcctccaa

SEQ ID NO: 11136 - DNA, 13 bp, Artificial Sequence
  synthetic sequence
ccccctgccctaa

SEQ ID NO: 11137 - DNA, 13 bp, Artificial Sequence
  synthetic sequence
cgctcttgccacg

SEQ ID NO: 11138 - DNA, 13 bp, Artificial Sequence
  synthetic sequence
aggatatgacccc

SEQ ID NO: 11139 - DNA, 13 bp, Artificial Sequence
  synthetic sequence
cacatggtgcccc

SEQ ID NO: 11140 - DNA, 13 bp, Artificial Sequence
  synthetic sequence
aaggtcagggccc

SEQ ID NO: 11141 - DNA, 13 bp, Artificial Sequence
  synthetic sequence
ttcgttttctgtt

SEQ ID NO: 11142 - DNA, 13 bp, Artificial Sequence
  synthetic sequence
gaaaaggtcaagg

SEQ ID NO: 11143 - DNA, 13 bp, Artificial Sequence
  synthetic sequence
cgggcctttgtcc

SEQ ID NO: 11144 - DNA, 13 bp, Artificial Sequence
  synthetic sequence
tttaacgaaaaag

SEQ ID NO: 11145 - DNA, 13 bp, Artificial Sequence
  synthetic sequence
ctctaccagcttt

SEQ ID NO: 11146 - DNA, 13 bp, Artificial Sequence
  synthetic sequence
gtatctccctgag

SEQ ID NO: 11147 - DNA, 13 bp, Artificial Sequence
  synthetic sequence
ctctcatcatctt

SEQ ID NO: 11148 - DNA, 13 bp, Artificial Sequence
  synthetic sequence
aatttctctcctg

SEQ ID NO: 11149 - DNA, 13 bp, Artificial Sequence
  synthetic sequence
tgaggggttgtcg

SEQ ID NO: 11150 - DNA, 13 bp, Artificial Sequence
  synthetic sequence
aggcaccacaggc

SEQ ID NO: 11151 - DNA, 13 bp, Artificial Sequence
  synthetic sequence
ggacacgtcaggg

SEQ ID NO: 11152 - DNA, 13 bp, Artificial Sequence
  synthetic sequence
cctgaactgtctc

SEQ ID NO: 11153 - DNA, 13 bp, Artificial Sequence
  synthetic sequence
ggcagtcagtcgt

SEQ ID NO: 11154 - DNA, 13 bp, Artificial Sequence
  synthetic sequence
cgtggagagccgg

SEQ ID NO: 11155 - DNA, 13 bp, Artificial Sequence
  synthetic sequence
tccatgattggca

SEQ ID NO: 11156 - DNA, 13 bp, Artificial Sequence
  synthetic sequence
gtgaggaaggccc

SEQ ID NO: 11157 - DNA, 13 bp, Artificial Sequence
  synthetic sequence
agagactgtgaag

SEQ ID NO: 11158 - DNA, 13 bp, Artificial Sequence
  synthetic sequence
tctgatgttgtgg

SEQ ID NO: 11159 - DNA, 13 bp, Artificial Sequence
  synthetic sequence
attgtaggggaca

SEQ ID NO: 11160 - DNA, 13 bp, Artificial Sequence
  synthetic sequence
caaataaggcctg

SEQ ID NO: 11161 - DNA, 13 bp, Artificial Sequence
  synthetic sequence
gagatcaaggcct

SEQ ID NO: 11162 - DNA, 13 bp, Artificial Sequence
  synthetic sequence
atgatggcccagt

SEQ ID NO: 11163 - DNA, 13 bp, Artificial Sequence
  synthetic sequence
tctacccatacat

SEQ ID NO: 11164 - DNA, 13 bp, Artificial Sequence
  synthetic sequence
gcagctcgcttga

SEQ ID NO: 11165 - DNA, 13 bp, Artificial Sequence
  synthetic sequence
gtataattagtgc

SEQ ID NO: 11166 - DNA, 13 bp, Artificial Sequence
  synthetic sequence
aggtggccagtag

SEQ ID NO: 11167 - DNA, 13 bp, Artificial Sequence
  synthetic sequence
gaggtgagcttaa

SEQ ID NO: 11168 - DNA, 13 bp, Artificial Sequence
  synthetic sequence
tcttagaggttct

SEQ ID NO: 11169 - DNA, 13 bp, Artificial Sequence
  synthetic sequence
gcgtctttaaggt

SEQ ID NO: 11170 - DNA, 13 bp, Artificial Sequence
  synthetic sequence
ggaacactggggt

SEQ ID NO: 11171 - DNA, 13 bp, Artificial Sequence
  synthetic sequence
atggctgcgaacg

SEQ ID NO: 11172 - DNA, 13 bp, Artificial Sequence
  synthetic sequence
gggtttataagag

SEQ ID NO: 11173 - DNA, 13 bp, Artificial Sequence
  synthetic sequence
ggtcctttccact

SEQ ID NO: 11174 - DNA, 13 bp, Artificial Sequence
  synthetic sequence
gtcaaactgctgc

SEQ ID NO: 11175 - DNA, 13 bp, Artificial Sequence
  synthetic sequence
gagggccgtctgt

SEQ ID NO: 11176 - DNA, 13 bp, Artificial Sequence
  synthetic sequence
gggctgagaaggc

SEQ ID NO: 11177 - DNA, 13 bp, Artificial Sequence
  synthetic sequence
aagttaagccagt

SEQ ID NO: 11178 - DNA, 13 bp, Artificial Sequence
  synthetic sequence
cggcagcgacggg

SEQ ID NO: 11179 - DNA, 13 bp, Artificial Sequence
  synthetic sequence
tgtgacagggcct

SEQ ID NO: 11180 - DNA, 13 bp, Artificial Sequence
  synthetic sequence
agtggtgaagctg

SEQ ID NO: 11181 - DNA, 13 bp, Artificial Sequence
  synthetic sequence
gcctgcctccagg

SEQ ID NO: 11182 - DNA, 13 bp, Artificial Sequence
  synthetic sequence
gggaaatatcttt

SEQ ID NO: 11183 - DNA, 13 bp, Artificial Sequence
  synthetic sequence
tagtgccggggcc

SEQ ID NO: 11184 - DNA, 13 bp, Artificial Sequence
  synthetic sequence
ttcattcacccgg

SEQ ID NO: 11185 - DNA, 13 bp, Artificial Sequence
  synthetic sequence
ggatgaatcgcca

SEQ ID NO: 11186 - DNA, 13 bp, Artificial Sequence
  synthetic sequence
tctcgccttaatc

SEQ ID NO: 11187 - DNA, 13 bp, Artificial Sequence
  synthetic sequence
gcggagacaagcc

SEQ ID NO: 11188 - DNA, 13 bp, Artificial Sequence
  synthetic sequence
agtagagaaatgg

SEQ ID NO: 11189 - DNA, 13 bp, Artificial Sequence
  synthetic sequence
aaaagggtggtgg

SEQ ID NO: 11190 - DNA, 13 bp, Artificial Sequence
  synthetic sequence
caaactggctggg

SEQ ID NO: 11191 - DNA, 13 bp, Artificial Sequence
  synthetic sequence
ggcagaatagatg

SEQ ID NO: 11192 - DNA, 13 bp, Artificial Sequence
  synthetic sequence
ggcaagattacag

SEQ ID NO: 11193 - DNA, 13 bp, Artificial Sequence
  synthetic sequence
tgtatttgtcgag

SEQ ID NO: 11194 - DNA, 13 bp, Artificial Sequence
  synthetic sequence
aagggggagtatt

SEQ ID NO: 11195 - DNA, 13 bp, Artificial Sequence
  synthetic sequence
aggcgttctacga

SEQ ID NO: 11196 - DNA, 13 bp, Artificial Sequence
  synthetic sequence
acgtagactgggt

SEQ ID NO: 11197 - DNA, 13 bp, Artificial Sequence
  synthetic sequence
gaggagactatag

SEQ ID NO: 11198 - DNA, 13 bp, Artificial Sequence
  synthetic sequence
atcataagtgagg

SEQ ID NO: 11199 - DNA, 13 bp, Artificial Sequence
  synthetic sequence
acagtagtggtgc

SEQ ID NO: 11200 - DNA, 13 bp, Artificial Sequence
  synthetic sequence
agctggggctgta

SEQ ID NO: 11201 - DNA, 13 bp, Artificial Sequence
  synthetic sequence
agcttcgatagtc

SEQ ID NO: 11202 - DNA, 13 bp, Artificial Sequence
  synthetic sequence
cattctttgtttg

SEQ ID NO: 11203 - DNA, 13 bp, Artificial Sequence
  synthetic sequence
agaaaagtgttcc

SEQ ID NO: 11204 - DNA, 13 bp, Artificial Sequence
  synthetic sequence
tgcagacaacgga

SEQ ID NO: 11205 - DNA, 13 bp, Artificial Sequence
  synthetic sequence
catgcccggagga

SEQ ID NO: 11206 - DNA, 13 bp, Artificial Sequence
  synthetic sequence
atagggctatgga

SEQ ID NO: 11207 - DNA, 13 bp, Artificial Sequence
  synthetic sequence
ttgggggaaagct

SEQ ID NO: 11208 - DNA, 13 bp, Artificial Sequence
  synthetic sequence
ccagtcaggactc

SEQ ID NO: 11209 - DNA, 13 bp, Artificial Sequence
  synthetic sequence
gagaaggcacggc

SEQ ID NO: 11210 - DNA, 13 bp, Artificial Sequence
  synthetic sequence
catttgccatggg

SEQ ID NO: 11211 - DNA, 13 bp, Artificial Sequence
  synthetic sequence
aaatataaaggag

SEQ ID NO: 11212 - DNA, 13 bp, Artificial Sequence
  synthetic sequence
aggcgtgaaactt

SEQ ID NO: 11213 - DNA, 13 bp, Artificial Sequence
  synthetic sequence
gtgattccagttt

SEQ ID NO: 11214 - DNA, 13 bp, Artificial Sequence
  synthetic sequence
taaggctatctag

SEQ ID NO: 11215 - DNA, 13 bp, Artificial Sequence
  synthetic sequence
gttcggcccgttg

SEQ ID NO: 11216 - DNA, 13 bp, Artificial Sequence
  synthetic sequence
gaagaggaaagcc

SEQ ID NO: 11217 - DNA, 13 bp, Artificial Sequence
  synthetic sequence
atgggagattagg

SEQ ID NO: 11218 - DNA, 13 bp, Artificial Sequence
  synthetic sequence
gggaggtagatcc

SEQ ID NO: 11219 - DNA, 13 bp, Artificial Sequence
  synthetic sequence
gggggatttgtgg

SEQ ID NO: 11220 - DNA, 13 bp, Artificial Sequence
  synthetic sequence
aggcttgcctaga

SEQ ID NO: 11221 - DNA, 13 bp, Artificial Sequence
  synthetic sequence
tgagggaatagat

SEQ ID NO: 11222 - DNA, 13 bp, Artificial Sequence
  synthetic sequence
taataggagggca

SEQ ID NO: 11223 - DNA, 13 bp, Artificial Sequence
  synthetic sequence
ggggcctgagagg

SEQ ID NO: 11224 - DNA, 13 bp, Artificial Sequence
  synthetic sequence
gggtaaaggaggg

SEQ ID NO: 11225 - DNA, 13 bp, Artificial Sequence
  synthetic sequence
aggctgaacggag

SEQ ID NO: 11226 - DNA, 13 bp, Artificial Sequence
  synthetic sequence
cggaaatgttttt

SEQ ID NO: 11227 - DNA, 13 bp, Artificial Sequence
  synthetic sequence
agaggaggggcgg

SEQ ID NO: 11228 - DNA, 13 bp, Artificial Sequence
  synthetic sequence
agtttctctcctg

SEQ ID NO: 11229 - DNA, 13 bp, Artificial Sequence
  synthetic sequence
gagagtgctatag

SEQ ID NO: 11230 - DNA, 13 bp, Artificial Sequence
  synthetic sequence
ccccaactgtgta

SEQ ID NO: 11231 - DNA, 13 bp, Artificial Sequence
  synthetic sequence
caggcaaagcgtg

SEQ ID NO: 11232 - DNA, 13 bp, Artificial Sequence
  synthetic sequence
aatgaaagggaaa

SEQ ID NO: 11233 - DNA, 13 bp, Artificial Sequence
  synthetic sequence
ctgggaggctcta

SEQ ID NO: 11234 - DNA, 13 bp, Artificial Sequence
  synthetic sequence
ggaagttgctgca

SEQ ID NO: 11235 - DNA, 13 bp, Artificial Sequence
  synthetic sequence
gggtagaagaaga

SEQ ID NO: 11236 - DNA, 13 bp, Artificial Sequence
  synthetic sequence
gggaggacctgcc

SEQ ID NO: 11237 - DNA, 13 bp, Artificial Sequence
  synthetic sequence
tgcgagccccctc

SEQ ID NO: 11238 - DNA, 13 bp, Artificial Sequence
  synthetic sequence
gatacgtcagggc

SEQ ID NO: 11239 - DNA, 13 bp, Artificial Sequence
  synthetic sequence
tgaagcgtgaaac

SEQ ID NO: 11240 - DNA, 13 bp, Artificial Sequence
  synthetic sequence
taggtctttcact

SEQ ID NO: 11241 - DNA, 13 bp, Artificial Sequence
  synthetic sequence
agaagtttatctg

SEQ ID NO: 11242 - DNA, 13 bp, Artificial Sequence
  synthetic sequence
gaaacttgagagg

SEQ ID NO: 11243 - DNA, 13 bp, Artificial Sequence
  synthetic sequence
gaacagcatgcaa

SEQ ID NO: 11244 - DNA, 13 bp, Artificial Sequence
  synthetic sequence
aaccaggagggcc

SEQ ID NO: 11245 - DNA, 13 bp, Artificial Sequence
  synthetic sequence
tggacggccagat

SEQ ID NO: 11246 - DNA, 13 bp, Artificial Sequence
  synthetic sequence
gattgtgatgaaa

SEQ ID NO: 11247 - DNA, 13 bp, Artificial Sequence
  synthetic sequence
aatcaatggagca

SEQ ID NO: 11248 - DNA, 13 bp, Artificial Sequence
  synthetic sequence
ggctctttgagaa

SEQ ID NO: 11249 - DNA, 13 bp, Artificial Sequence
  synthetic sequence
cccttcatgctgg

SEQ ID NO: 11250 - DNA, 13 bp, Artificial Sequence
  synthetic sequence
accatgggaatta

SEQ ID NO: 11251 - DNA, 13 bp, Artificial Sequence
  synthetic sequence
aggacatctggtg

SEQ ID NO: 11252 - DNA, 13 bp, Artificial Sequence
  synthetic sequence
ggatggaatgtga

SEQ ID NO: 11253 - DNA, 13 bp, Artificial Sequence
  synthetic sequence
gcttggctggatt

SEQ ID NO: 11254 - DNA, 13 bp, Artificial Sequence
  synthetic sequence
tggttcatgtggc

SEQ ID NO: 11255 - DNA, 13 bp, Artificial Sequence
  synthetic sequence
tggatgcttggca

SEQ ID NO: 11256 - DNA, 13 bp, Artificial Sequence
  synthetic sequence
tgctcatgcagag

SEQ ID NO: 11257 - DNA, 13 bp, Artificial Sequence
  synthetic sequence
gttggagatgaat

SEQ ID NO: 11258 - DNA, 13 bp, Artificial Sequence
  synthetic sequence
gtgctcctcatag

SEQ ID NO: 11259 - DNA, 13 bp, Artificial Sequence
  synthetic sequence
cagtgtggagagg

SEQ ID NO: 11260 - DNA, 13 bp, Artificial Sequence
  synthetic sequence
gaccaacgtcagg

SEQ ID NO: 11261 - DNA, 13 bp, Artificial Sequence
  synthetic sequence
ccggctcacccat

SEQ ID NO: 11262 - DNA, 13 bp, Artificial Sequence
  synthetic sequence
atgtggtgctagt

SEQ ID NO: 11263 - DNA, 13 bp, Artificial Sequence
  synthetic sequence
gcttgttggacgg

SEQ ID NO: 11264 - DNA, 13 bp, Artificial Sequence
  synthetic sequence
gatggacgaacca

SEQ ID NO: 11265 - DNA, 13 bp, Artificial Sequence
  synthetic sequence
ctcatggcaaatg

SEQ ID NO: 11266 - DNA, 13 bp, Artificial Sequence
  synthetic sequence
tggagctactacg

SEQ ID NO: 11267 - DNA, 13 bp, Artificial Sequence
  synthetic sequence
gaacagttgtcat

SEQ ID NO: 11268 - DNA, 13 bp, Artificial Sequence
  synthetic sequence
ggaaagcatgggg

SEQ ID NO: 11269 - DNA, 13 bp, Artificial Sequence
  synthetic sequence
atagcatggatga

SEQ ID NO: 11270 - DNA, 13 bp, Artificial Sequence
  synthetic sequence
tgggacacgccat

SEQ ID NO: 11271 - DNA, 13 bp, Artificial Sequence
  synthetic sequence
ttcatgggaaaga

SEQ ID NO: 11272 - DNA, 13 bp, Artificial Sequence
  synthetic sequence
ttggctgttgggg

SEQ ID NO: 11273 - DNA, 13 bp, Artificial Sequence
  synthetic sequence
aatgttttccaca

SEQ ID NO: 11274 - DNA, 13 bp, Artificial Sequence
  synthetic sequence
ggcacaaagtggt

SEQ ID NO: 11275 - DNA, 13 bp, Artificial Sequence
  synthetic sequence
tagcgctcacatc

SEQ ID NO: 11276 - DNA, 13 bp, Artificial Sequence
  synthetic sequence
ctcaacgcaatgt

SEQ ID NO: 11277 - DNA, 13 bp, Artificial Sequence
  synthetic sequence
gggggaatgtctt

SEQ ID NO: 11278 - DNA, 13 bp, Artificial Sequence
  synthetic sequence
tggtggcagcaaa

SEQ ID NO: 11279 - DNA, 13 bp, Artificial Sequence
  synthetic sequence
acttgtcacggga

SEQ ID NO: 11280 - DNA, 13 bp, Artificial Sequence
  synthetic sequence
tagaaggagccag

SEQ ID NO: 11281 - DNA, 13 bp, Artificial Sequence
  synthetic sequence
aggcagcagccat

SEQ ID NO: 11282 - DNA, 13 bp, Artificial Sequence
  synthetic sequence
ctgcaatcacagg

SEQ ID NO: 11283 - DNA, 13 bp, Artificial Sequence
  synthetic sequence
acaaaagaggagg

SEQ ID NO: 11284 - DNA, 13 bp, Artificial Sequence
  synthetic sequence
gctcttgggtcac

SEQ ID NO: 11285 - DNA, 13 bp, Artificial Sequence
  synthetic sequence
tccagacaaaacc

SEQ ID NO: 11286 - DNA, 13 bp, Artificial Sequence
  synthetic sequence
acatacacatgcc

SEQ ID NO: 11287 - DNA, 13 bp, Artificial Sequence
  synthetic sequence
aaacaacactcgt

SEQ ID NO: 11288 - DNA, 13 bp, Artificial Sequence
  synthetic sequence
agatcgtccacaa

SEQ ID NO: 11289 - DNA, 13 bp, Artificial Sequence
  synthetic sequence
gagtgtgatggag

SEQ ID NO: 11290 - DNA, 13 bp, Artificial Sequence
  synthetic sequence
ccttcggagactc

SEQ ID NO: 11291 - DNA, 13 bp, Artificial Sequence
  synthetic sequence
gaagtggcatctt

SEQ ID NO: 11292 - DNA, 13 bp, Artificial Sequence
  synthetic sequence
accaggcattcca

SEQ ID NO: 11293 - DNA, 13 bp, Artificial Sequence
  synthetic sequence
gaagacatgctgc

SEQ ID NO: 11294 - DNA, 13 bp, Artificial Sequence
  synthetic sequence
tcccagtacgata

SEQ ID NO: 11295 - DNA, 13 bp, Artificial Sequence
  synthetic sequence
caatgtgcctcca

SEQ ID NO: 11296 - DNA, 13 bp, Artificial Sequence
  synthetic sequence
caggcgtccaaaa

SEQ ID NO: 11297 - DNA, 13 bp, Artificial Sequence
  synthetic sequence
agcattgacacat

SEQ ID NO: 11298 - DNA, 13 bp, Artificial Sequence
  synthetic sequence
agcatggcactgg

SEQ ID NO: 11299 - DNA, 13 bp, Artificial Sequence
  synthetic sequence
agcagtggaagga

SEQ ID NO: 11300 - DNA, 13 bp, Artificial Sequence
  synthetic sequence
tgcgcatgtcttg

SEQ ID NO: 11301 - DNA, 13 bp, Artificial Sequence
  synthetic sequence
ctctagtgctcac

SEQ ID NO: 11302 - DNA, 13 bp, Artificial Sequence
  synthetic sequence
tacgtcaccacat

SEQ ID NO: 11303 - DNA, 13 bp, Artificial Sequence
  synthetic sequence
ggactctcatcaa

SEQ ID NO: 11304 - DNA, 13 bp, Artificial Sequence
  synthetic sequence
aacagaggtcaca

SEQ ID NO: 11305 - DNA, 13 bp, Artificial Sequence
  synthetic sequence
tgggaggacatcc

SEQ ID NO: 11306 - DNA, 13 bp, Artificial Sequence
  synthetic sequence
acaaaagtcacca

SEQ ID NO: 11307 - DNA, 13 bp, Artificial Sequence
  synthetic sequence
tcacgtacgaatg

SEQ ID NO: 11308 - DNA, 13 bp, Artificial Sequence
  synthetic sequence
aacagagtgccca

SEQ ID NO: 11309 - DNA, 13 bp, Artificial Sequence
  synthetic sequence
agccaacttgctg

SEQ ID NO: 11310 - DNA, 13 bp, Artificial Sequence
  synthetic sequence
gtgttggtgacgg

SEQ ID NO: 11311 - DNA, 13 bp, Artificial Sequence
  synthetic sequence
ctggggtagtgtg

SEQ ID NO: 11312 - DNA, 13 bp, Artificial Sequence
  synthetic sequence
gacctagagagtt

SEQ ID NO: 11313 - DNA, 13 bp, Artificial Sequence
  synthetic sequence
ccctcaagtggtt

SEQ ID NO: 11314 - DNA, 13 bp, Artificial Sequence
  synthetic sequence
tgcgaggagagtg

SEQ ID NO: 11315 - DNA, 13 bp, Artificial Sequence
  synthetic sequence
ccgggaatgaggg

SEQ ID NO: 11316 - DNA, 13 bp, Artificial Sequence
  synthetic sequence
agcttttgatgac

SEQ ID NO: 11317 - DNA, 13 bp, Artificial Sequence
  synthetic sequence
ctgacaccacccc

SEQ ID NO: 11318 - DNA, 13 bp, Artificial Sequence
  synthetic sequence
aacttggtgacta

SEQ ID NO: 11319 - DNA, 13 bp, Artificial Sequence
  synthetic sequence
gtggaaaagagtg

SEQ ID NO: 11320 - DNA, 13 bp, Artificial Sequence
  synthetic sequence
tagccggaccaaa

SEQ ID NO: 11321 - DNA, 13 bp, Artificial Sequence
  synthetic sequence
tgaagggagctca

SEQ ID NO: 11322 - DNA, 13 bp, Artificial Sequence
  synthetic sequence
actgactggtgct

SEQ ID NO: 11323 - DNA, 13 bp, Artificial Sequence
  synthetic sequence
gctctctcgtcaa

SEQ ID NO: 11324 - DNA, 13 bp, Artificial Sequence
  synthetic sequence
gctgcccagagaa

SEQ ID NO: 11325 - DNA, 13 bp, Artificial Sequence
  synthetic sequence
ctcggaaacccat

SEQ ID NO: 11326 - DNA, 13 bp, Artificial Sequence
  synthetic sequence
atcgtgcagggtg

SEQ ID NO: 11327 - DNA, 13 bp, Artificial Sequence
  synthetic sequence
caatcacgagatg

SEQ ID NO: 11328 - DNA, 13 bp, Artificial Sequence
  synthetic sequence
ccccaagtccaga

SEQ ID NO: 11329 - DNA, 13 bp, Artificial Sequence
  synthetic sequence
cccacgactggag

SEQ ID NO: 11330 - DNA, 13 bp, Artificial Sequence
  synthetic sequence
acatcaggccacc

SEQ ID NO: 11331 - DNA, 13 bp, Artificial Sequence
  synthetic sequence
gctttggccttct

SEQ ID NO: 11332 - DNA, 13 bp, Artificial Sequence
  synthetic sequence
cttaggacggctg

SEQ ID NO: 11333 - DNA, 13 bp, Artificial Sequence
  synthetic sequence
aggaaaattctgc

SEQ ID NO: 11334 - DNA, 13 bp, Artificial Sequence
  synthetic sequence
ttgatgggccgcg

SEQ ID NO: 11335 - DNA, 13 bp, Artificial Sequence
  synthetic sequence
tagaaaatgaagc

SEQ ID NO: 11336 - DNA, 13 bp, Artificial Sequence
  synthetic sequence
gatgcactggaaa

SEQ ID NO: 11337 - DNA, 13 bp, Artificial Sequence
  synthetic sequence
aacactttcacga

SEQ ID NO: 11338 - DNA, 13 bp, Artificial Sequence
  synthetic sequence
aatggagactggg

SEQ ID NO: 11339 - DNA, 13 bp, Artificial Sequence
  synthetic sequence
atagggaatggtt

SEQ ID NO: 11340 - DNA, 13 bp, Artificial Sequence
  synthetic sequence
ggcatggagcagt

SEQ ID NO: 11341 - DNA, 13 bp, Artificial Sequence
  synthetic sequence
gcagtggacctca

SEQ ID NO: 11342 - DNA, 13 bp, Artificial Sequence
  synthetic sequence
cccaatccatgat

SEQ ID NO: 11343 - DNA, 13 bp, Artificial Sequence
  synthetic sequence
gattgggactttg

SEQ ID NO: 11344 - DNA, 13 bp, Artificial Sequence
  synthetic sequence
caccctgttctgt

SEQ ID NO: 11345 - DNA, 13 bp, Artificial Sequence
  synthetic sequence
gctcagtgaagtt

SEQ ID NO: 11346 - DNA, 13 bp, Artificial Sequence
  synthetic sequence
gcggtggatctca

SEQ ID NO: 11347 - DNA, 13 bp, Artificial Sequence
  synthetic sequence
tcaagcttggtga

SEQ ID NO: 11348 - DNA, 13 bp, Artificial Sequence
  synthetic sequence
ttgccatcactgt

SEQ ID NO: 11349 - DNA, 13 bp, Artificial Sequence
  synthetic sequence
agtgtggcaatga

SEQ ID NO: 11350 - DNA, 13 bp, Artificial Sequence
  synthetic sequence
caacaactttgaa

SEQ ID NO: 11351 - DNA, 13 bp, Artificial Sequence
  synthetic sequence
agatgtactgggt

SEQ ID NO: 11352 - DNA, 13 bp, Artificial Sequence
  synthetic sequence
ctgcttagaacgg

SEQ ID NO: 11353 - DNA, 13 bp, Artificial Sequence
  synthetic sequence
agttctctcgtca

SEQ ID NO: 11354 - DNA, 13 bp, Artificial Sequence
  synthetic sequence
ttgatggaccacg

SEQ ID NO: 11355 - DNA, 13 bp, Artificial Sequence
  synthetic sequence
aagcccacaacga

SEQ ID NO: 11356 - DNA, 13 bp, Artificial Sequence
  synthetic sequence
ggaggctggtaac

SEQ ID NO: 11357 - DNA, 13 bp, Artificial Sequence
  synthetic sequence
aatggccatgacc

SEQ ID NO: 11358 - DNA, 13 bp, Artificial Sequence
  synthetic sequence
tacgctctcaaca

SEQ ID NO: 11359 - DNA, 13 bp, Artificial Sequence
  synthetic sequence
ttctctaccgcct

SEQ ID NO: 11360 - DNA, 13 bp, Artificial Sequence
  synthetic sequence
tgagggctctata

SEQ ID NO: 11361 - DNA, 13 bp, Artificial Sequence
  synthetic sequence
acttggaaaatga

SEQ ID NO: 11362 - DNA, 13 bp, Artificial Sequence
  synthetic sequence
cacaaccggagag

SEQ ID NO: 11363 - DNA, 13 bp, Artificial Sequence
  synthetic sequence
cagaggcactcag

SEQ ID NO: 11364 - DNA, 13 bp, Artificial Sequence
  synthetic sequence
ccatcctagagga

SEQ ID NO: 11365 - DNA, 13 bp, Artificial Sequence
  synthetic sequence
ctgatgaccatca

SEQ ID NO: 11366 - DNA, 13 bp, Artificial Sequence
  synthetic sequence
aatgtgcatgtgg

SEQ ID NO: 11367 - DNA, 13 bp, Artificial Sequence
  synthetic sequence
caatcgccctggc

SEQ ID NO: 11368 - DNA, 13 bp, Artificial Sequence
  synthetic sequence
accatttgcgagg

SEQ ID NO: 11369 - DNA, 13 bp, Artificial Sequence
  synthetic sequence
cttacatgcccaa

SEQ ID NO: 11370 - DNA, 13 bp, Artificial Sequence
  synthetic sequence
gaccgtcaagagg

SEQ ID NO: 11371 - DNA, 13 bp, Artificial Sequence
  synthetic sequence
ccccaaataatca

SEQ ID NO: 11372 - DNA, 13 bp, Artificial Sequence
  synthetic sequence
gcagatcaccaag

SEQ ID NO: 11373 - DNA, 13 bp, Artificial Sequence
  synthetic sequence
aagagaatccaga

SEQ ID NO: 11374 - DNA, 13 bp, Artificial Sequence
  synthetic sequence
ctttgtgggacaa

SEQ ID NO: 11375 - DNA, 13 bp, Artificial Sequence
  synthetic sequence
tgacgccatactg

SEQ ID NO: 11376 - DNA, 13 bp, Artificial Sequence
  synthetic sequence
cagaaccggaaaa

SEQ ID NO: 11377 - DNA, 13 bp, Artificial Sequence
  synthetic sequence
agactaatgtcac

SEQ ID NO: 11378 - DNA, 13 bp, Artificial Sequence
  synthetic sequence
tctggtccatagg

SEQ ID NO: 11379 - DNA, 13 bp, Artificial Sequence
  synthetic sequence
cagggctagacgt

SEQ ID NO: 11380 - DNA, 13 bp, Artificial Sequence
  synthetic sequence
attgcccagggac

SEQ ID NO: 11381 - DNA, 13 bp, Artificial Sequence
  synthetic sequence
acagggaatggtt

SEQ ID NO: 11382 - DNA, 13 bp, Artificial Sequence
  synthetic sequence
ggacgtccgcatg

SEQ ID NO: 11383 - DNA, 13 bp, Artificial Sequence
  synthetic sequence
ttgcttggactct

SEQ ID NO: 11384 - DNA, 13 bp, Artificial Sequence
  synthetic sequence
ctcacaagctggc

SEQ ID NO: 11385 - DNA, 13 bp, Artificial Sequence
  synthetic sequence
acgtatgaatgtc

SEQ ID NO: 11386 - DNA, 13 bp, Artificial Sequence
  synthetic sequence
catgtgcaaaatt

SEQ ID NO: 11387 - DNA, 13 bp, Artificial Sequence
  synthetic sequence
aatggaaggaaaa

SEQ ID NO: 11388 - DNA, 13 bp, Artificial Sequence
  synthetic sequence
tgcgtatgtcttg

SEQ ID NO: 11389 - DNA, 13 bp, Artificial Sequence
  synthetic sequence
aggtctggaacag

SEQ ID NO: 11390 - DNA, 13 bp, Artificial Sequence
  synthetic sequence
caaagagcgggga

SEQ ID NO: 11391 - DNA, 13 bp, Artificial Sequence
  synthetic sequence
gtagaaaagtaga

SEQ ID NO: 11392 - DNA, 13 bp, Artificial Sequence
  synthetic sequence
agctaccttcttc

SEQ ID NO: 11393 - DNA, 13 bp, Artificial Sequence
  synthetic sequence
ctttgagagggct

SEQ ID NO: 11394 - DNA, 13 bp, Artificial Sequence
  synthetic sequence
tcacaagaaaaga

SEQ ID NO: 11395 - DNA, 13 bp, Artificial Sequence
  synthetic sequence
tgcgtccagccac

SEQ ID NO: 11396 - DNA, 13 bp, Artificial Sequence
  synthetic sequence
atacatcctccgt

SEQ ID NO: 11397 - DNA, 13 bp, Artificial Sequence
  synthetic sequence
ctcaaagagaatg

SEQ ID NO: 11398 - DNA, 13 bp, Artificial Sequence
  synthetic sequence
acgtccaatatgg

SEQ ID NO: 11399 - DNA, 13 bp, Artificial Sequence
  synthetic sequence
gacgagtgtgatg

SEQ ID NO: 11400 - DNA, 13 bp, Artificial Sequence
  synthetic sequence
ctagaattaccag

SEQ ID NO: 11401 - DNA, 13 bp, Artificial Sequence
  synthetic sequence
ctgtccagctcgt

SEQ ID NO: 11402 - DNA, 13 bp, Artificial Sequence
  synthetic sequence
ggaaggctgcagt

SEQ ID NO: 11403 - DNA, 13 bp, Artificial Sequence
  synthetic sequence
gatcacaggttga

SEQ ID NO: 11404 - DNA, 13 bp, Artificial Sequence
  synthetic sequence
tggaggacaacac

SEQ ID NO: 11405 - DNA, 13 bp, Artificial Sequence
  synthetic sequence
ccgttgttgctct

SEQ ID NO: 11406 - DNA, 13 bp, Artificial Sequence
  synthetic sequence
aggctcaatcatg

SEQ ID NO: 11407 - DNA, 13 bp, Artificial Sequence
  synthetic sequence
tatggaccagaga

SEQ ID NO: 11408 - DNA, 13 bp, Artificial Sequence
  synthetic sequence
tagcgaagatcgt

SEQ ID NO: 11409 - DNA, 13 bp, Artificial Sequence
  synthetic sequence
caggaggtgtgct

SEQ ID NO: 11410 - DNA, 13 bp, Artificial Sequence
  synthetic sequence
actcctacatcgt

SEQ ID NO: 11411 - DNA, 13 bp, Artificial Sequence
  synthetic sequence
cagaagcttacac

SEQ ID NO: 11412 - DNA, 13 bp, Artificial Sequence
  synthetic sequence
agctttagacacc

SEQ ID NO: 11413 - DNA, 13 bp, Artificial Sequence
  synthetic sequence
gagtttttgtcgg

SEQ ID NO: 11414 - DNA, 13 bp, Artificial Sequence
  synthetic sequence
ccaaagcagatct

SEQ ID NO: 11415 - DNA, 13 bp, Artificial Sequence
  synthetic sequence
cttagaactgctt

SEQ ID NO: 11416 - DNA, 13 bp, Artificial Sequence
  synthetic sequence
acaggcataaagt

SEQ ID NO: 11417 - DNA, 13 bp, Artificial Sequence
  synthetic sequence
tggtgccttcaga

SEQ ID NO: 11418 - DNA, 13 bp, Artificial Sequence
  synthetic sequence
gactacatgacct

SEQ ID NO: 11419 - DNA, 13 bp, Artificial Sequence
  synthetic sequence
attaaggacgcta

SEQ ID NO: 11420 - DNA, 13 bp, Artificial Sequence
  synthetic sequence
gcagtcggaggct

SEQ ID NO: 11421 - DNA, 13 bp, Artificial Sequence
  synthetic sequence
gaggatacattgc

SEQ ID NO: 11422 - DNA, 13 bp, Artificial Sequence
  synthetic sequence
aaaagaaaggagc

SEQ ID NO: 11423 - DNA, 13 bp, Artificial Sequence
  synthetic sequence
aaatcaccctcac

SEQ ID NO: 11424 - DNA, 13 bp, Artificial Sequence
  synthetic sequence
ccgcccctacgat

SEQ ID NO: 11425 - DNA, 13 bp, Artificial Sequence
  synthetic sequence
ctggagaccgtta

SEQ ID NO: 11426 - DNA, 13 bp, Artificial Sequence
  synthetic sequence
tctccccctgtcc

SEQ ID NO: 11427 - DNA, 13 bp, Artificial Sequence
  synthetic sequence
agaaggacagcgg

SEQ ID NO: 11428 - DNA, 13 bp, Artificial Sequence
  synthetic sequence
aaaagagggggcg

SEQ ID NO: 11429 - DNA, 13 bp, Artificial Sequence
  synthetic sequence
agaagctcacaac

SEQ ID NO: 11430 - DNA, 13 bp, Artificial Sequence
  synthetic sequence
tgggtggacttgg

SEQ ID NO: 11431 - DNA, 13 bp, Artificial Sequence
  synthetic sequence
aaaaatccggcgg

SEQ ID NO: 11432 - DNA, 13 bp, Artificial Sequence
  synthetic sequence
gagaagtttgaaa

SEQ ID NO: 11433 - DNA, 13 bp, Artificial Sequence
  synthetic sequence
agaatggggactg

SEQ ID NO: 11434 - DNA, 13 bp, Artificial Sequence
  synthetic sequence
gagaatgtttttc

SEQ ID NO: 11435 - DNA, 13 bp, Artificial Sequence
  synthetic sequence
cttgctgaagtca

SEQ ID NO: 11436 - DNA, 13 bp, Artificial Sequence
  synthetic sequence
atgaacatgctta

SEQ ID NO: 11437 - DNA, 13 bp, Artificial Sequence
  synthetic sequence
ctccacttcctca

SEQ ID NO: 11438 - DNA, 13 bp, Artificial Sequence
  synthetic sequence
acctttttcctat

SEQ ID NO: 11439 - DNA, 13 bp, Artificial Sequence
  synthetic sequence
cttggaaacccat

SEQ ID NO: 11440 - DNA, 13 bp, Artificial Sequence
  synthetic sequence
cctagattccaat

SEQ ID NO: 11441 - DNA, 13 bp, Artificial Sequence
  synthetic sequence
cagaagcttaaag

SEQ ID NO: 11442 - DNA, 13 bp, Artificial Sequence
  synthetic sequence
cttgcgtcttatg

SEQ ID NO: 11443 - DNA, 13 bp, Artificial Sequence
  synthetic sequence
agacgaggtgtaa

SEQ ID NO: 11444 - DNA, 13 bp, Artificial Sequence
  synthetic sequence
tgcaggctaaaaa

SEQ ID NO: 11445 - DNA, 13 bp, Artificial Sequence
  synthetic sequence
tggcttagtatcg

SEQ ID NO: 11446 - DNA, 13 bp, Artificial Sequence
  synthetic sequence
tgtgggcgtggag

SEQ ID NO: 11447 - DNA, 13 bp, Artificial Sequence
  synthetic sequence
tgtgccactccgc

SEQ ID NO: 11448 - DNA, 13 bp, Artificial Sequence
  synthetic sequence
ctcagtgtggtgg

SEQ ID NO: 11449 - DNA, 13 bp, Artificial Sequence
  synthetic sequence
atcctgaatgccg

SEQ ID NO: 11450 - DNA, 13 bp, Artificial Sequence
  synthetic sequence
tggctcagccagc

SEQ ID NO: 11451 - DNA, 13 bp, Artificial Sequence
  synthetic sequence
cattggagaccat

SEQ ID NO: 11452 - DNA, 13 bp, Artificial Sequence
  synthetic sequence
acgaatgtcctaa

SEQ ID NO: 11453 - DNA, 13 bp, Artificial Sequence
  synthetic sequence
tttcctcaacgca

SEQ ID NO: 11454 - DNA, 13 bp, Artificial Sequence
  synthetic sequence
ccttatgaaaaca

SEQ ID NO: 11455 - DNA, 13 bp, Artificial Sequence
  synthetic sequence
cggcgctctgtgc

SEQ ID NO: 11456 - DNA, 13 bp, Artificial Sequence
  synthetic sequence
gggaatacgcggg

SEQ ID NO: 11457 - DNA, 13 bp, Artificial Sequence
  synthetic sequence
gggtctcctctaa

SEQ ID NO: 11458 - DNA, 13 bp, Artificial Sequence
  synthetic sequence
gctggcctgactc

SEQ ID NO: 11459 - DNA, 13 bp, Artificial Sequence
  synthetic sequence
tcaatatgctgtt

SEQ ID NO: 11460 - DNA, 13 bp, Artificial Sequence
  synthetic sequence
tccattcattttc

SEQ ID NO: 11461 - DNA, 13 bp, Artificial Sequence
  synthetic sequence
aggtctgatttcc

SEQ ID NO: 11462 - DNA, 13 bp, Artificial Sequence
  synthetic sequence
aacttgaagaacg

SEQ ID NO: 11463 - DNA, 13 bp, Artificial Sequence
  synthetic sequence
ccttgtgtgatcc

SEQ ID NO: 11464 - DNA, 13 bp, Artificial Sequence
  synthetic sequence
tgcggtgttcacc

SEQ ID NO: 11465 - DNA, 13 bp, Artificial Sequence
  synthetic sequence
cccccaagcatca

SEQ ID NO: 11466 - DNA, 13 bp, Artificial Sequence
  synthetic sequence
ggctggtcatgtt

SEQ ID NO: 11467 - DNA, 13 bp, Artificial Sequence
  synthetic sequence
ctcggctcagcca

SEQ ID NO: 11468 - DNA, 13 bp, Artificial Sequence
  synthetic sequence
tgcggtccacctc

SEQ ID NO: 11469 - DNA, 13 bp, Artificial Sequence
  synthetic sequence
agccatctcggct

SEQ ID NO: 11470 - DNA, 13 bp, Artificial Sequence
  synthetic sequence
ttctctgtttctc

SEQ ID NO: 11471 - DNA, 13 bp, Artificial Sequence
  synthetic sequence
tcctgggtggcca

SEQ ID NO: 11472 - DNA, 13 bp, Artificial Sequence
  synthetic sequence
gtggcgaccattc

SEQ ID NO: 11473 - DNA, 13 bp, Artificial Sequence
  synthetic sequence
ttgcctctgtcca

SEQ ID NO: 11474 - DNA, 13 bp, Artificial Sequence
  synthetic sequence
gctggttggatct

SEQ ID NO: 11475 - DNA, 13 bp, Artificial Sequence
  synthetic sequence
ccccgcttgttca

SEQ ID NO: 11476 - DNA, 13 bp, Artificial Sequence
  synthetic sequence
ctggggctgcgca

SEQ ID NO: 11477 - DNA, 13 bp, Artificial Sequence
  synthetic sequence
cccacggtcatga

SEQ ID NO: 11478 - DNA, 13 bp, Artificial Sequence
  synthetic sequence
cttccgagacggt

SEQ ID NO: 11479 - DNA, 13 bp, Artificial Sequence
  synthetic sequence
cacgatggctcct

SEQ ID NO: 11480 - DNA, 13 bp, Artificial Sequence
  synthetic sequence
gcatgcacattgg

SEQ ID NO: 11481 - DNA, 13 bp, Artificial Sequence
  synthetic sequence
gatatcacgtcca

SEQ ID NO: 11482 - DNA, 13 bp, Artificial Sequence
  synthetic sequence
tcagcctccatca

SEQ ID NO: 11483 - DNA, 13 bp, Artificial Sequence
  synthetic sequence
tgtcagtgactga

SEQ ID NO: 11484 - DNA, 13 bp, Artificial Sequence
  synthetic sequence
gggttgatgtgat

SEQ ID NO: 11485 - DNA, 13 bp, Artificial Sequence
  synthetic sequence
gaaggcttccatt

SEQ ID NO: 11486 - DNA, 13 bp, Artificial Sequence
  synthetic sequence
ggaacctctgccg

SEQ ID NO: 11487 - DNA, 13 bp, Artificial Sequence
  synthetic sequence
gtccctggttttg

SEQ ID NO: 11488 - DNA, 13 bp, Artificial Sequence
  synthetic sequence
cgatggaagtata

SEQ ID NO: 11489 - DNA, 13 bp, Artificial Sequence
  synthetic sequence
tattctgtgtcat

SEQ ID NO: 11490 - DNA, 13 bp, Artificial Sequence
  synthetic sequence
tagttgtgtgcca

SEQ ID NO: 11491 - DNA, 13 bp, Artificial Sequence
  synthetic sequence
gtggtggaattcc

SEQ ID NO: 11492 - DNA, 13 bp, Artificial Sequence
  synthetic sequence
cagggagcatgta

SEQ ID NO: 11493 - DNA, 13 bp, Artificial Sequence
  synthetic sequence
ctgatcgccatcc

SEQ ID NO: 11494 - DNA, 13 bp, Artificial Sequence
  synthetic sequence
ccattagtccggc

SEQ ID NO: 11495 - DNA, 13 bp, Artificial Sequence
  synthetic sequence
atgaccctgctcg

SEQ ID NO: 11496 - DNA, 13 bp, Artificial Sequence
  synthetic sequence
tttgtcgtttgcc

SEQ ID NO: 11497 - DNA, 13 bp, Artificial Sequence
  synthetic sequence
gcgtgcttccagc

SEQ ID NO: 11498 - DNA, 13 bp, Artificial Sequence
  synthetic sequence
ccacctttcgtgt

SEQ ID NO: 11499 - DNA, 13 bp, Artificial Sequence
  synthetic sequence
atggcaaacatca

SEQ ID NO: 11500 - DNA, 13 bp, Artificial Sequence
  synthetic sequence
gcacaagcggggt

SEQ ID NO: 11501 - DNA, 13 bp, Artificial Sequence
  synthetic sequence
tctcaatccagta

SEQ ID NO: 11502 - DNA, 13 bp, Artificial Sequence
  synthetic sequence
accagcacctttg

SEQ ID NO: 11503 - DNA, 13 bp, Artificial Sequence
  synthetic sequence
gcacctctatgaa

SEQ ID NO: 11504 - DNA, 13 bp, Artificial Sequence
  synthetic sequence
caatcaagtgaaa

SEQ ID NO: 11505 - DNA, 13 bp, Artificial Sequence
  synthetic sequence
cacctctgagacg

SEQ ID NO: 11506 - DNA, 13 bp, Artificial Sequence
  synthetic sequence
ctctccttttgag

SEQ ID NO: 11507 - DNA, 13 bp, Artificial Sequence
  synthetic sequence
gtgtactgaatgc

SEQ ID NO: 11508 - DNA, 13 bp, Artificial Sequence
  synthetic sequence
tagatgttctcag

SEQ ID NO: 11509 - DNA, 13 bp, Artificial Sequence
  synthetic sequence
tcatctgtctctt

SEQ ID NO: 11510 - DNA, 13 bp, Artificial Sequence
  synthetic sequence
caactccattgcc

SEQ ID NO: 11511 - DNA, 13 bp, Artificial Sequence
  synthetic sequence
aaggcacgcctcg

SEQ ID NO: 11512 - DNA, 13 bp, Artificial Sequence
  synthetic sequence
ccattcccagaca

SEQ ID NO: 11513 - DNA, 13 bp, Artificial Sequence
  synthetic sequence
aagactggcatgg

SEQ ID NO: 11514 - DNA, 13 bp, Artificial Sequence
  synthetic sequence
cctataccctttc

SEQ ID NO: 11515 - DNA, 13 bp, Artificial Sequence
  synthetic sequence
gccaggaaagcat

SEQ ID NO: 11516 - DNA, 13 bp, Artificial Sequence
  synthetic sequence
tcagagccagttt

SEQ ID NO: 11517 - DNA, 13 bp, Artificial Sequence
  synthetic sequence
tctgctgctacca

SEQ ID NO: 11518 - DNA, 13 bp, Artificial Sequence
  synthetic sequence
caatcggaatttt

SEQ ID NO: 11519 - DNA, 13 bp, Artificial Sequence
  synthetic sequence
caaacatgctctt

SEQ ID NO: 11520 - DNA, 13 bp, Artificial Sequence
  synthetic sequence
cctatggagttga

SEQ ID NO: 11521 - DNA, 13 bp, Artificial Sequence
  synthetic sequence
aaagcggcgggaa

SEQ ID NO: 11522 - DNA, 13 bp, Artificial Sequence
  synthetic sequence
ctttccactgtca

SEQ ID NO: 11523 - DNA, 13 bp, Artificial Sequence
  synthetic sequence
cggtatggatgct

SEQ ID NO: 11524 - DNA, 13 bp, Artificial Sequence
  synthetic sequence
ctctgcacgggac

SEQ ID NO: 11525 - DNA, 13 bp, Artificial Sequence
  synthetic sequence
cactggttatggg

SEQ ID NO: 11526 - DNA, 13 bp, Artificial Sequence
  synthetic sequence
aagccttgtttgc

SEQ ID NO: 11527 - DNA, 13 bp, Artificial Sequence
  synthetic sequence
gatccattcgtat

SEQ ID NO: 11528 - DNA, 13 bp, Artificial Sequence
  synthetic sequence
gtttgctcatgag

SEQ ID NO: 11529 - DNA, 13 bp, Artificial Sequence
  synthetic sequence
ttggcgagacaaa

SEQ ID NO: 11530 - DNA, 13 bp, Artificial Sequence
  synthetic sequence
atctgttccattc

SEQ ID NO: 11531 - DNA, 13 bp, Artificial Sequence
  synthetic sequence
gggcgtttctggc

SEQ ID NO: 11532 - DNA, 13 bp, Artificial Sequence
  synthetic sequence
gctgagcgatatc

SEQ ID NO: 11533 - DNA, 13 bp, Artificial Sequence
  synthetic sequence
tctccctttccca

SEQ ID NO: 11534 - DNA, 13 bp, Artificial Sequence
  synthetic sequence
ccaacctccccga

SEQ ID NO: 11535 - DNA, 13 bp, Artificial Sequence
  synthetic sequence
agaggggttagca

SEQ ID NO: 11536 - DNA, 13 bp, Artificial Sequence
  synthetic sequence
agtcagatgtcat

SEQ ID NO: 11537 - DNA, 13 bp, Artificial Sequence
  synthetic sequence
ccactatttcatt

SEQ ID NO: 11538 - DNA, 13 bp, Artificial Sequence
  synthetic sequence
gaactctccccat

SEQ ID NO: 11539 - DNA, 13 bp, Artificial Sequence
  synthetic sequence
tcgagagccattc

SEQ ID NO: 11540 - DNA, 13 bp, Artificial Sequence
  synthetic sequence
ttttctggctgga

SEQ ID NO: 11541 - DNA, 13 bp, Artificial Sequence
  synthetic sequence
tggttgtcacacc

SEQ ID NO: 11542 - DNA, 13 bp, Artificial Sequence
  synthetic sequence
ctccttgctttcc

SEQ ID NO: 11543 - DNA, 13 bp, Artificial Sequence
  synthetic sequence
aaatccctatgac

SEQ ID NO: 11544 - DNA, 13 bp, Artificial Sequence
  synthetic sequence
acggcttcccaca

SEQ ID NO: 11545 - DNA, 13 bp, Artificial Sequence
  synthetic sequence
aatccctctagcc

SEQ ID NO: 11546 - DNA, 13 bp, Artificial Sequence
  synthetic sequence
ttgcttttcctga

SEQ ID NO: 11547 - DNA, 13 bp, Artificial Sequence
  synthetic sequence
ttgtctcaggtcc

SEQ ID NO: 11548 - DNA, 13 bp, Artificial Sequence
  synthetic sequence
tctcctttcgagt

SEQ ID NO: 11549 - DNA, 13 bp, Artificial Sequence
  synthetic sequence
tgagcttcatcca

SEQ ID NO: 11550 - DNA, 13 bp, Artificial Sequence
  synthetic sequence
actagatgaccct

SEQ ID NO: 11551 - DNA, 13 bp, Artificial Sequence
  synthetic sequence
gagccttcgtgtc

SEQ ID NO: 11552 - DNA, 13 bp, Artificial Sequence
  synthetic sequence
actagcccacctc

SEQ ID NO: 11553 - DNA, 13 bp, Artificial Sequence
  synthetic sequence
atctcccaaaacc

SEQ ID NO: 11554 - DNA, 13 bp, Artificial Sequence
  synthetic sequence
ccacggtcaagac

SEQ ID NO: 11555 - DNA, 13 bp, Artificial Sequence
  synthetic sequence
gtgtctctggcca

SEQ ID NO: 11556 - DNA, 13 bp, Artificial Sequence
  synthetic sequence
aaggcagccccta

SEQ ID NO: 11557 - DNA, 13 bp, Artificial Sequence
  synthetic sequence
ggccttccccttt

SEQ ID NO: 11558 - DNA, 13 bp, Artificial Sequence
  synthetic sequence
ttgccgcctggga

SEQ ID NO: 11559 - DNA, 13 bp, Artificial Sequence
  synthetic sequence
ccgtggttccagg

SEQ ID NO: 11560 - DNA, 13 bp, Artificial Sequence
  synthetic sequence
ccactccactctt

SEQ ID NO: 11561 - DNA, 13 bp, Artificial Sequence
  synthetic sequence
tgacgaggaacgc

SEQ ID NO: 11562 - DNA, 13 bp, Artificial Sequence
  synthetic sequence
gacaacttcatgg

SEQ ID NO: 11563 - DNA, 13 bp, Artificial Sequence
  synthetic sequence
ggttgacgagaaa

SEQ ID NO: 11564 - DNA, 13 bp, Artificial Sequence
  synthetic sequence
ccttttgaggtgg

SEQ ID NO: 11565 - DNA, 13 bp, Artificial Sequence
  synthetic sequence
ccatctcccagaa

SEQ ID NO: 11566 - DNA, 13 bp, Artificial Sequence
  synthetic sequence
cctctcttgcagc

SEQ ID NO: 11567 - DNA, 13 bp, Artificial Sequence
  synthetic sequence
cagataagaaaca

SEQ ID NO: 11568 - DNA, 13 bp, Artificial Sequence
  synthetic sequence
gtacttgatgttc

SEQ ID NO: 11569 - DNA, 13 bp, Artificial Sequence
  synthetic sequence
ttccatcttttct

SEQ ID NO: 11570 - DNA, 13 bp, Artificial Sequence
  synthetic sequence
gctggtggctcag

SEQ ID NO: 11571 - DNA, 13 bp, Artificial Sequence
  synthetic sequence
aactcctgtggtg

SEQ ID NO: 11572 - DNA, 13 bp, Artificial Sequence
  synthetic sequence
aaagagtgtgtgt

SEQ ID NO: 11573 - DNA, 13 bp, Artificial Sequence
  synthetic sequence
tgtacctatctac

SEQ ID NO: 11574 - DNA, 13 bp, Artificial Sequence
  synthetic sequence
tcatcggcataca

SEQ ID NO: 11575 - DNA, 13 bp, Artificial Sequence
  synthetic sequence
ttgtctcgggtcc

SEQ ID NO: 11576 - DNA, 13 bp, Artificial Sequence
  synthetic sequence
tcagctgttgcca

SEQ ID NO: 11577 - DNA, 13 bp, Artificial Sequence
  synthetic sequence
cacagattcccac

SEQ ID NO: 11578 - DNA, 13 bp, Artificial Sequence
  synthetic sequence
acaactgtgctcc

SEQ ID NO: 11579 - DNA, 13 bp, Artificial Sequence
  synthetic sequence
ccttccccacagc

SEQ ID NO: 11580 - DNA, 13 bp, Artificial Sequence
  synthetic sequence
ttgctgcttgaga

SEQ ID NO: 11581 - DNA, 13 bp, Artificial Sequence
  synthetic sequence
ctaaatgaccctg

SEQ ID NO: 11582 - DNA, 13 bp, Artificial Sequence
  synthetic sequence
gcagcccggtcca

SEQ ID NO: 11583 - DNA, 13 bp, Artificial Sequence
  synthetic sequence
gaagctagttgga

SEQ ID NO: 11584 - DNA, 13 bp, Artificial Sequence
  synthetic sequence
ttccccatgcgtt

SEQ ID NO: 11585 - DNA, 13 bp, Artificial Sequence
  synthetic sequence
cttcatggctccg

SEQ ID NO: 11586 - DNA, 13 bp, Artificial Sequence
  synthetic sequence
tcagtgaagtgag

SEQ ID NO: 11587 - DNA, 13 bp, Artificial Sequence
  synthetic sequence
ggcttgtcagcgt

SEQ ID NO: 11588 - DNA, 13 bp, Artificial Sequence
  synthetic sequence
gcacattacgtct

SEQ ID NO: 11589 - DNA, 13 bp, Artificial Sequence
  synthetic sequence
cagtccacgtctt

SEQ ID NO: 11590 - DNA, 13 bp, Artificial Sequence
  synthetic sequence
cgtagtgtgcgtt

SEQ ID NO: 11591 - DNA, 13 bp, Artificial Sequence
  synthetic sequence
gtcatggataggc

SEQ ID NO: 11592 - DNA, 13 bp, Artificial Sequence
  synthetic sequence
gatcaaacctcca

SEQ ID NO: 11593 - DNA, 13 bp, Artificial Sequence
  synthetic sequence
tccgagggtttgt

SEQ ID NO: 11594 - DNA, 13 bp, Artificial Sequence
  synthetic sequence
gggtaatccagac

SEQ ID NO: 11595 - DNA, 13 bp, Artificial Sequence
  synthetic sequence
gagttttgctgag

SEQ ID NO: 11596 - DNA, 13 bp, Artificial Sequence
  synthetic sequence
gcttcaccactcc

SEQ ID NO: 11597 - DNA, 13 bp, Artificial Sequence
  synthetic sequence
cgcatattctgtg

SEQ ID NO: 11598 - DNA, 13 bp, Artificial Sequence
  synthetic sequence
gtgccacgttgtg

SEQ ID NO: 11599 - DNA, 13 bp, Artificial Sequence
  synthetic sequence
gtagtggttctga

SEQ ID NO: 11600 - DNA, 13 bp, Artificial Sequence
  synthetic sequence
ccccacccacgat

SEQ ID NO: 11601 - DNA, 13 bp, Artificial Sequence
  synthetic sequence
tgcgctggttatg

SEQ ID NO: 11602 - DNA, 13 bp, Artificial Sequence
  synthetic sequence
ctttccgccgaac

SEQ ID NO: 11603 - DNA, 13 bp, Artificial Sequence
  synthetic sequence
aggttgtgccttt

SEQ ID NO: 11604 - DNA, 13 bp, Artificial Sequence
  synthetic sequence
ctcatcctgtcct

SEQ ID NO: 11605 - DNA, 13 bp, Artificial Sequence
  synthetic sequence
catcactcccaga

SEQ ID NO: 11606 - DNA, 13 bp, Artificial Sequence
  synthetic sequence
ctgtaagccggag

SEQ ID NO: 11607 - DNA, 13 bp, Artificial Sequence
  synthetic sequence
tatgatccagttc

SEQ ID NO: 11608 - DNA, 13 bp, Artificial Sequence
  synthetic sequence
gagccaaagtccc

SEQ ID NO: 11609 - DNA, 13 bp, Artificial Sequence
  synthetic sequence
ccccattgccata

SEQ ID NO: 11610 - DNA, 13 bp, Artificial Sequence
  synthetic sequence
cgcgtcggtgcca

SEQ ID NO: 11611 - DNA, 13 bp, Artificial Sequence
  synthetic sequence
tcaagtctaggtc

SEQ ID NO: 11612 - DNA, 13 bp, Artificial Sequence
  synthetic sequence
atcctcctgtcat

SEQ ID NO: 11613 - DNA, 13 bp, Artificial Sequence
  synthetic sequence
ggaaatttgacaa

SEQ ID NO: 11614 - DNA, 13 bp, Artificial Sequence
  synthetic sequence
gccaccttgtagg

SEQ ID NO: 11615 - DNA, 13 bp, Artificial Sequence
  synthetic sequence
ctggtttatcgcc

SEQ ID NO: 11616 - DNA, 13 bp, Artificial Sequence
  synthetic sequence
tttgtaaaacacg

SEQ ID NO: 11617 - DNA, 13 bp, Artificial Sequence
  synthetic sequence
cctctatgaagct

SEQ ID NO: 11618 - DNA, 13 bp, Artificial Sequence
  synthetic sequence
cgggatcatcaat

SEQ ID NO: 11619 - DNA, 13 bp, Artificial Sequence
  synthetic sequence
aacttcattgctc

SEQ ID NO: 11620 - DNA, 13 bp, Artificial Sequence
  synthetic sequence
acagtggtgacat

SEQ ID NO: 11621 - DNA, 13 bp, Artificial Sequence
  synthetic sequence
tggaagtcgcgac

SEQ ID NO: 11622 - DNA, 13 bp, Artificial Sequence
  synthetic sequence
atggtgacggagg

SEQ ID NO: 11623 - DNA, 13 bp, Artificial Sequence
  synthetic sequence
ccatccattgtga

SEQ ID NO: 11624 - DNA, 13 bp, Artificial Sequence
  synthetic sequence
acgacaagtcact

SEQ ID NO: 11625 - DNA, 13 bp, Artificial Sequence
  synthetic sequence
gtgttactgtaaa

SEQ ID NO: 11626 - DNA, 13 bp, Artificial Sequence
  synthetic sequence
gtgcaaatctagc

SEQ ID NO: 11627 - DNA, 13 bp, Artificial Sequence
  synthetic sequence
ctatctccttcta

SEQ ID NO: 11628 - DNA, 13 bp, Artificial Sequence
  synthetic sequence
gagtgagccaata

SEQ ID NO: 11629 - DNA, 13 bp, Artificial Sequence
  synthetic sequence
tgacttcctggac

SEQ ID NO: 11630 - DNA, 13 bp, Artificial Sequence
  synthetic sequence
agctacatacttc

SEQ ID NO: 11631 - DNA, 13 bp, Artificial Sequence
  synthetic sequence
ttgggtattctgt

SEQ ID NO: 11632 - DNA, 13 bp, Artificial Sequence
  synthetic sequence
tcgccagaaccat

SEQ ID NO: 11633 - DNA, 13 bp, Artificial Sequence
  synthetic sequence
tctgttctctcct

SEQ ID NO: 11634 - DNA, 13 bp, Artificial Sequence
  synthetic sequence
aaaaggccttgcc

SEQ ID NO: 11635 - DNA, 13 bp, Artificial Sequence
  synthetic sequence
gtagttccaggcg

SEQ ID NO: 11636 - DNA, 13 bp, Artificial Sequence
  synthetic sequence
caaaccacctacg

SEQ ID NO: 11637 - DNA, 13 bp, Artificial Sequence
  synthetic sequence
gcccctaggacca

SEQ ID NO: 11638 - DNA, 13 bp, Artificial Sequence
  synthetic sequence
catatctgttgct

SEQ ID NO: 11639 - DNA, 13 bp, Artificial Sequence
  synthetic sequence
agtcgtctccgct

SEQ ID NO: 11640 - DNA, 13 bp, Artificial Sequence
  synthetic sequence
tttcttcaacacc

SEQ ID NO: 11641 - DNA, 13 bp, Artificial Sequence
  synthetic sequence
ctattttggttcc

SEQ ID NO: 11642 - DNA, 13 bp, Artificial Sequence
  synthetic sequence
ccccgtagcggtg

SEQ ID NO: 11643 - DNA, 13 bp, Artificial Sequence
  synthetic sequence
gccagccatgcga

SEQ ID NO: 11644 - DNA, 13 bp, Artificial Sequence
  synthetic sequence
acacgagttgatg

SEQ ID NO: 11645 - DNA, 13 bp, Artificial Sequence
  synthetic sequence
atgtgatcgctcg

SEQ ID NO: 11646 - DNA, 13 bp, Artificial Sequence
  synthetic sequence
ccagcacagtcat

SEQ ID NO: 11647 - DNA, 13 bp, Artificial Sequence
  synthetic sequence
gggtcggtgaagt

SEQ ID NO: 11648 - DNA, 13 bp, Artificial Sequence
  synthetic sequence
gaagtataggagt

SEQ ID NO: 11649 - DNA, 13 bp, Artificial Sequence
  synthetic sequence
ttcaaggagggct

SEQ ID NO: 11650 - DNA, 13 bp, Artificial Sequence
  synthetic sequence
ctggttgtgtgcc

SEQ ID NO: 11651 - DNA, 13 bp, Artificial Sequence
  synthetic sequence
tctgcagtcaatg

SEQ ID NO: 11652 - DNA, 13 bp, Artificial Sequence
  synthetic sequence
tgcagaccattag

SEQ ID NO: 11653 - DNA, 13 bp, Artificial Sequence
  synthetic sequence
ggggtgcgaaaca

SEQ ID NO: 11654 - DNA, 13 bp, Artificial Sequence
  synthetic sequence
tgcagaacttcca

SEQ ID NO: 11655 - DNA, 13 bp, Artificial Sequence
  synthetic sequence
tggtccaatgacc

SEQ ID NO: 11656 - DNA, 13 bp, Artificial Sequence
  synthetic sequence
tatgctccttcca

SEQ ID NO: 11657 - DNA, 13 bp, Artificial Sequence
  synthetic sequence
gtcaatggcacat

SEQ ID NO: 11658 - DNA, 13 bp, Artificial Sequence
  synthetic sequence
gtggagttagcca

SEQ ID NO: 11659 - DNA, 13 bp, Artificial Sequence
  synthetic sequence
atcatcagcgtac

SEQ ID NO: 11660 - DNA, 13 bp, Artificial Sequence
  synthetic sequence
tctcactttctgt

SEQ ID NO: 11661 - DNA, 13 bp, Artificial Sequence
  synthetic sequence
attctcgtcccaa

SEQ ID NO: 11662 - DNA, 13 bp, Artificial Sequence
  synthetic sequence
tcttcgtatctcc

SEQ ID NO: 11663 - DNA, 13 bp, Artificial Sequence
  synthetic sequence
caggatgtcctgc

SEQ ID NO: 11664 - DNA, 13 bp, Artificial Sequence
  synthetic sequence
tgacgtaaaacgc

SEQ ID NO: 11665 - DNA, 13 bp, Artificial Sequence
  synthetic sequence
tgatagcagtaac

SEQ ID NO: 11666 - DNA, 13 bp, Artificial Sequence
  synthetic sequence
cacctgtccactc

SEQ ID NO: 11667 - DNA, 13 bp, Artificial Sequence
  synthetic sequence
gcaggccgcactc

SEQ ID NO: 11668 - DNA, 13 bp, Artificial Sequence
  synthetic sequence
ccaatggagccga

SEQ ID NO: 11669 - DNA, 13 bp, Artificial Sequence
  synthetic sequence
acggcgtcaatga

SEQ ID NO: 11670 - DNA, 13 bp, Artificial Sequence
  synthetic sequence
tccacatcctctg

SEQ ID NO: 11671 - DNA, 13 bp, Artificial Sequence
  synthetic sequence
cacggctgttctc

SEQ ID NO: 11672 - DNA, 13 bp, Artificial Sequence
  synthetic sequence
agcgtcctgcctc

SEQ ID NO: 11673 - DNA, 13 bp, Artificial Sequence
  synthetic sequence
ccagtctagtgac

SEQ ID NO: 11674 - DNA, 13 bp, Artificial Sequence
  synthetic sequence
aggaacactgcca

SEQ ID NO: 11675 - DNA, 13 bp, Artificial Sequence
  synthetic sequence
aacggcactggct

SEQ ID NO: 11676 - DNA, 13 bp, Artificial Sequence
  synthetic sequence
gtagactcctgtg

SEQ ID NO: 11677 - DNA, 13 bp, Artificial Sequence
  synthetic sequence
ataaaattgttga

SEQ ID NO: 11678 - DNA, 13 bp, Artificial Sequence
  synthetic sequence
caacaacagattt

SEQ ID NO: 11679 - DNA, 13 bp, Artificial Sequence
  synthetic sequence
agcaatacattca

SEQ ID NO: 11680 - DNA, 13 bp, Artificial Sequence
  synthetic sequence
taatagatgaatt

SEQ ID NO: 11681 - DNA, 13 bp, Artificial Sequence
  synthetic sequence
agcaattcaagaa

SEQ ID NO: 11682 - DNA, 13 bp, Artificial Sequence
  synthetic sequence
aaatgatatctga

SEQ ID NO: 11683 - DNA, 13 bp, Artificial Sequence
  synthetic sequence
taacaatagttca

SEQ ID NO: 11684 - DNA, 13 bp, Artificial Sequence
  synthetic sequence
aagagatgactag

SEQ ID NO: 11685 - DNA, 13 bp, Artificial Sequence
  synthetic sequence
ttaaagacaatag

SEQ ID NO: 11686 - DNA, 13 bp, Artificial Sequence
  synthetic sequence
gctactatgacta

SEQ ID NO: 11687 - DNA, 13 bp, Artificial Sequence
  synthetic sequence
atgccactagtga

SEQ ID NO: 11688 - DNA, 13 bp, Artificial Sequence
  synthetic sequence
tctagagctataa

SEQ ID NO: 11689 - DNA, 13 bp, Artificial Sequence
  synthetic sequence
taatagacttttc

SEQ ID NO: 11690 - DNA, 13 bp, Artificial Sequence
  synthetic sequence
acatttggatgcc

SEQ ID NO: 11691 - DNA, 13 bp, Artificial Sequence
  synthetic sequence
taccaccatggaa

SEQ ID NO: 11692 - DNA, 13 bp, Artificial Sequence
  synthetic sequence
aaatccaaacata

SEQ ID NO: 11693 - DNA, 13 bp, Artificial Sequence
  synthetic sequence
caaaatctgcaaa

SEQ ID NO: 11694 - DNA, 13 bp, Artificial Sequence
  synthetic sequence
tggacattaatgg

SEQ ID NO: 11695 - DNA, 13 bp, Artificial Sequence
  synthetic sequence
tcttatctgtgtc

SEQ ID NO: 11696 - DNA, 13 bp, Artificial Sequence
  synthetic sequence
gttaagaactgga

SEQ ID NO: 11697 - DNA, 13 bp, Artificial Sequence
  synthetic sequence
aaataaatgcaga

SEQ ID NO: 11698 - DNA, 13 bp, Artificial Sequence
  synthetic sequence
ataaacttcaatc

SEQ ID NO: 11699 - DNA, 13 bp, Artificial Sequence
  synthetic sequence
gatatattttctc

SEQ ID NO: 11700 - DNA, 13 bp, Artificial Sequence
  synthetic sequence
tccctaaatgttt

SEQ ID NO: 11701 - DNA, 13 bp, Artificial Sequence
  synthetic sequence
ataccattgcttt

SEQ ID NO: 11702 - DNA, 13 bp, Artificial Sequence
  synthetic sequence
gatagagagatat

SEQ ID NO: 11703 - DNA, 13 bp, Artificial Sequence
  synthetic sequence
attgattatttcc

SEQ ID NO: 11704 - DNA, 13 bp, Artificial Sequence
  synthetic sequence
ctgcaattatgag

SEQ ID NO: 11705 - DNA, 13 bp, Artificial Sequence
  synthetic sequence
aatgcttgctttg

SEQ ID NO: 11706 - DNA, 13 bp, Artificial Sequence
  synthetic sequence
agatttttgaaga

SEQ ID NO: 11707 - DNA, 13 bp, Artificial Sequence
  synthetic sequence
ttatgggtgagac

SEQ ID NO: 11708 - DNA, 13 bp, Artificial Sequence
  synthetic sequence
aagcaactgtagt

SEQ ID NO: 11709 - DNA, 13 bp, Artificial Sequence
  synthetic sequence
atggttgtccacc

SEQ ID NO: 11710 - DNA, 13 bp, Artificial Sequence
  synthetic sequence
tatatggaatctg

SEQ ID NO: 11711 - DNA, 13 bp, Artificial Sequence
  synthetic sequence
ccatgatggaaca

SEQ ID NO: 11712 - DNA, 13 bp, Artificial Sequence
  synthetic sequence
tcaatatatggca

SEQ ID NO: 11713 - DNA, 13 bp, Artificial Sequence
  synthetic sequence
caattaagacagg

SEQ ID NO: 11714 - DNA, 13 bp, Artificial Sequence
  synthetic sequence
cctatcctctacc

SEQ ID NO: 11715 - DNA, 13 bp, Artificial Sequence
  synthetic sequence
ctatgatgataac

SEQ ID NO: 11716 - DNA, 13 bp, Artificial Sequence
  synthetic sequence
ttttatttcaatg

SEQ ID NO: 11717 - DNA, 13 bp, Artificial Sequence
  synthetic sequence
atataaggaatag

SEQ ID NO: 11718 - DNA, 13 bp, Artificial Sequence
  synthetic sequence
attgtaccaaaca

SEQ ID NO: 11719 - DNA, 13 bp, Artificial Sequence
  synthetic sequence
aggaatgaagagc

SEQ ID NO: 11720 - DNA, 13 bp, Artificial Sequence
  synthetic sequence
caatgtctgtgta

SEQ ID NO: 11721 - DNA, 13 bp, Artificial Sequence
  synthetic sequence
aatgatgtaccat

SEQ ID NO: 11722 - DNA, 13 bp, Artificial Sequence
  synthetic sequence
tatgaagaattct

SEQ ID NO: 11723 - DNA, 13 bp, Artificial Sequence
  synthetic sequence
atagaaatagtta

SEQ ID NO: 11724 - DNA, 13 bp, Artificial Sequence
  synthetic sequence
acagaggcttata

SEQ ID NO: 11725 - DNA, 13 bp, Artificial Sequence
  synthetic sequence
agatttagttcat

SEQ ID NO: 11726 - DNA, 13 bp, Artificial Sequence
  synthetic sequence
taatacatcattc

SEQ ID NO: 11727 - DNA, 13 bp, Artificial Sequence
  synthetic sequence
cttgttttatggg

SEQ ID NO: 11728 - DNA, 13 bp, Artificial Sequence
  synthetic sequence
atactgcaaggga

SEQ ID NO: 11729 - DNA, 13 bp, Artificial Sequence
  synthetic sequence
aggaaaactcctg

SEQ ID NO: 11730 - DNA, 13 bp, Artificial Sequence
  synthetic sequence
aagatgctaataa

SEQ ID NO: 11731 - DNA, 13 bp, Artificial Sequence
  synthetic sequence
atgcaaccttcaa

SEQ ID NO: 11732 - DNA, 13 bp, Artificial Sequence
  synthetic sequence
gaatgattggcaa

SEQ ID NO: 11733 - DNA, 13 bp, Artificial Sequence
  synthetic sequence
actacaaggcaaa

SEQ ID NO: 11734 - DNA, 13 bp, Artificial Sequence
  synthetic sequence
atacttcttgata

SEQ ID NO: 11735 - DNA, 13 bp, Artificial Sequence
  synthetic sequence
aataggaacaatt

SEQ ID NO: 11736 - DNA, 13 bp, Artificial Sequence
  synthetic sequence
ggttatatgagtt

SEQ ID NO: 11737 - DNA, 13 bp, Artificial Sequence
  synthetic sequence
tattcaaacatga

SEQ ID NO: 11738 - DNA, 13 bp, Artificial Sequence
  synthetic sequence
aatatagagtttg

SEQ ID NO: 11739 - DNA, 13 bp, Artificial Sequence
  synthetic sequence
aacagaagaaaat

SEQ ID NO: 11740 - DNA, 13 bp, Artificial Sequence
  synthetic sequence
tttgaagaatctg

SEQ ID NO: 11741 - DNA, 13 bp, Artificial Sequence
  synthetic sequence
tacaaaacttaca

SEQ ID NO: 11742 - DNA, 13 bp, Artificial Sequence
  synthetic sequence
tgatacaccattc

SEQ ID NO: 11743 - DNA, 13 bp, Artificial Sequence
  synthetic sequence
acagaagcttata

SEQ ID NO: 11744 - DNA, 13 bp, Artificial Sequence
  synthetic sequence
tagagaatagaaa

SEQ ID NO: 11745 - DNA, 13 bp, Artificial Sequence
  synthetic sequence
atatagaatttga

SEQ ID NO: 11746 - DNA, 13 bp, Artificial Sequence
  synthetic sequence
catatgacaacat

SEQ ID NO: 11747 - DNA, 13 bp, Artificial Sequence
  synthetic sequence
caacctttaaact

SEQ ID NO: 11748 - DNA, 13 bp, Artificial Sequence
  synthetic sequence
agactacaagaca

SEQ ID NO: 11749 - DNA, 13 bp, Artificial Sequence
  synthetic sequence
ctttagaaaggag

SEQ ID NO: 11750 - DNA, 13 bp, Artificial Sequence
  synthetic sequence
ttaaacatgataa

SEQ ID NO: 11751 - DNA, 13 bp, Artificial Sequence
  synthetic sequence
tagagcccaaaca

SEQ ID NO: 11752 - DNA, 13 bp, Artificial Sequence
  synthetic sequence
atctcgtcatttg

SEQ ID NO: 11753 - DNA, 13 bp, Artificial Sequence
  synthetic sequence
atataaataatgt

SEQ ID NO: 11754 - DNA, 13 bp, Artificial Sequence
  synthetic sequence
tatacttcatgtg

SEQ ID NO: 11755 - DNA, 13 bp, Artificial Sequence
  synthetic sequence
caagacagggctc

SEQ ID NO: 11756 - DNA, 13 bp, Artificial Sequence
  synthetic sequence
agaatatacaatg

SEQ ID NO: 11757 - DNA, 13 bp, Artificial Sequence
  synthetic sequence
cccatgatgataa

SEQ ID NO: 11758 - DNA, 13 bp, Artificial Sequence
  synthetic sequence
aatttgttgagaa

SEQ ID NO: 11759 - DNA, 13 bp, Artificial Sequence
  synthetic sequence
gatggatatcggg

SEQ ID NO: 11760 - DNA, 13 bp, Artificial Sequence
  synthetic sequence
ctcaaaactaatt

SEQ ID NO: 11761 - DNA, 13 bp, Artificial Sequence
  synthetic sequence
agaatgcctgctt

SEQ ID NO: 11762 - DNA, 13 bp, Artificial Sequence
  synthetic sequence
tataattccaaaa

SEQ ID NO: 11763 - DNA, 13 bp, Artificial Sequence
  synthetic sequence
tatggtccacaaa

SEQ ID NO: 11764 - DNA, 13 bp, Artificial Sequence
  synthetic sequence
ttctgacagataa

SEQ ID NO: 11765 - DNA, 13 bp, Artificial Sequence
  synthetic sequence
gtgcaatgtctgt

SEQ ID NO: 11766 - DNA, 13 bp, Artificial Sequence
  synthetic sequence
atgatgtaccgtt

SEQ ID NO: 11767 - DNA, 13 bp, Artificial Sequence
  synthetic sequence
tgcaagagatgca

SEQ ID NO: 11768 - DNA, 13 bp, Artificial Sequence
  synthetic sequence
cactaataagatt

SEQ ID NO: 11769 - DNA, 13 bp, Artificial Sequence
  synthetic sequence
tgagagggaggtc

SEQ ID NO: 11770 - DNA, 13 bp, Artificial Sequence
  synthetic sequence
ctgaaaatataac

SEQ ID NO: 11771 - DNA, 13 bp, Artificial Sequence
  synthetic sequence
gaacaagtatgcc

SEQ ID NO: 11772 - DNA, 13 bp, Artificial Sequence
  synthetic sequence
tgagaagcaccat

SEQ ID NO: 11773 - DNA, 13 bp, Artificial Sequence
  synthetic sequence
agtataatagtat

SEQ ID NO: 11774 - DNA, 13 bp, Artificial Sequence
  synthetic sequence
catgggtatctat

SEQ ID NO: 11775 - DNA, 13 bp, Artificial Sequence
  synthetic sequence
ttgttcacttatt

SEQ ID NO: 11776 - DNA, 13 bp, Artificial Sequence
  synthetic sequence
taagcatcccgat

SEQ ID NO: 11777 - DNA, 13 bp, Artificial Sequence
  synthetic sequence
gatagaaatagtc

SEQ ID NO: 11778 - DNA, 13 bp, Artificial Sequence
  synthetic sequence
tctaactaggaaa

SEQ ID NO: 11779 - DNA, 13 bp, Artificial Sequence
  synthetic sequence
ctatgatggaaca

SEQ ID NO: 11780 - DNA, 13 bp, Artificial Sequence
  synthetic sequence
caatttatggcag

SEQ ID NO: 11781 - DNA, 13 bp, Artificial Sequence
  synthetic sequence
tgatgttcccaaa

SEQ ID NO: 11782 - DNA, 13 bp, Artificial Sequence
  synthetic sequence
actgcaagagacg

SEQ ID NO: 11783 - DNA, 13 bp, Artificial Sequence
  synthetic sequence
gattattttccag

SEQ ID NO: 11784 - DNA, 13 bp, Artificial Sequence
  synthetic sequence
tattaataagatc

SEQ ID NO: 11785 - DNA, 13 bp, Artificial Sequence
  synthetic sequence
cggcaaagcaagg

SEQ ID NO: 11786 - DNA, 13 bp, Artificial Sequence
  synthetic sequence
aacagataaaccc

SEQ ID NO: 11787 - DNA, 13 bp, Artificial Sequence
  synthetic sequence
ttactgatagaga

SEQ ID NO: 11788 - DNA, 13 bp, Artificial Sequence
  synthetic sequence
atatttgttggag

SEQ ID NO: 11789 - DNA, 13 bp, Artificial Sequence
  synthetic sequence
ccctcgtcttgtg

SEQ ID NO: 11790 - DNA, 13 bp, Artificial Sequence
  synthetic sequence
gctttaccctgcg

SEQ ID NO: 11791 - DNA, 13 bp, Artificial Sequence
  synthetic sequence
gcaaacatctcgt

SEQ ID NO: 11792 - DNA, 13 bp, Artificial Sequence
  synthetic sequence
acctttgcttttt

SEQ ID NO: 11793 - DNA, 13 bp, Artificial Sequence
  synthetic sequence
tcctatctgtgtc

SEQ ID NO: 11794 - DNA, 13 bp, Artificial Sequence
  synthetic sequence
ccctagtgatgag

SEQ ID NO: 11795 - DNA, 13 bp, Artificial Sequence
  synthetic sequence
gaagaaagagggt

SEQ ID NO: 11796 - DNA, 13 bp, Artificial Sequence
  synthetic sequence
aactcattagcta

SEQ ID NO: 11797 - DNA, 13 bp, Artificial Sequence
  synthetic sequence
aatcatttgcgga

SEQ ID NO: 11798 - DNA, 13 bp, Artificial Sequence
  synthetic sequence
gttatgacagaga

SEQ ID NO: 11799 - DNA, 13 bp, Artificial Sequence
  synthetic sequence
aagttgttgagca

SEQ ID NO: 11800 - DNA, 13 bp, Artificial Sequence
  synthetic sequence
tgagagggttcaa

SEQ ID NO: 11801 - DNA, 13 bp, Artificial Sequence
  synthetic sequence
aacagacaacgaa

SEQ ID NO: 11802 - DNA, 13 bp, Artificial Sequence
  synthetic sequence
atacccaggcaat

SEQ ID NO: 11803 - DNA, 13 bp, Artificial Sequence
  synthetic sequence
tgagaatacaaat

SEQ ID NO: 11804 - DNA, 13 bp, Artificial Sequence
  synthetic sequence
tgatggatattgg

SEQ ID NO: 11805 - DNA, 13 bp, Artificial Sequence
  synthetic sequence
aaaaagttgcata

SEQ ID NO: 11806 - DNA, 13 bp, Artificial Sequence
  synthetic sequence
atgactagatttt

SEQ ID NO: 11807 - DNA, 13 bp, Artificial Sequence
  synthetic sequence
aatttatacagtt

SEQ ID NO: 11808 - DNA, 13 bp, Artificial Sequence
  synthetic sequence
ccattctttatta

SEQ ID NO: 11809 - DNA, 13 bp, Artificial Sequence
  synthetic sequence
tagcacacatagc

SEQ ID NO: 11810 - DNA, 13 bp, Artificial Sequence
  synthetic sequence
taaaatgtatgct

SEQ ID NO: 11811 - DNA, 13 bp, Artificial Sequence
  synthetic sequence
agacttttatctt

SEQ ID NO: 11812 - DNA, 13 bp, Artificial Sequence
  synthetic sequence
tcatatccattat

SEQ ID NO: 11813 - DNA, 13 bp, Artificial Sequence
  synthetic sequence
atgatattcgact

SEQ ID NO: 11814 - DNA, 13 bp, Artificial Sequence
  synthetic sequence
ttaactacacata

SEQ ID NO: 11815 - DNA, 13 bp, Artificial Sequence
  synthetic sequence
cctgggttgaata

SEQ ID NO: 11816 - DNA, 13 bp, Artificial Sequence
  synthetic sequence
tttcaaatttaag

SEQ ID NO: 11817 - DNA, 13 bp, Artificial Sequence
  synthetic sequence
tgtatgtcatatg

SEQ ID NO: 11818 - DNA, 13 bp, Artificial Sequence
  synthetic sequence
ctgcaaaatgggt

SEQ ID NO: 11819 - DNA, 13 bp, Artificial Sequence
  synthetic sequence
ccagacaatatct

SEQ ID NO: 11820 - DNA, 13 bp, Artificial Sequence
  synthetic sequence
gtgaaagcttttc

SEQ ID NO: 11821 - DNA, 13 bp, Artificial Sequence
  synthetic sequence
tcactagggtcca

SEQ ID NO: 11822 - DNA, 13 bp, Artificial Sequence
  synthetic sequence
tataaaattatct

SEQ ID NO: 11823 - DNA, 13 bp, Artificial Sequence
  synthetic sequence
taatatgtggtgc

SEQ ID NO: 11824 - DNA, 13 bp, Artificial Sequence
  synthetic sequence
actttagttgata

SEQ ID NO: 11825 - DNA, 13 bp, Artificial Sequence
  synthetic sequence
ttagcttcatatt

SEQ ID NO: 11826 - DNA, 13 bp, Artificial Sequence
  synthetic sequence
agccaatttctct

SEQ ID NO: 11827 - DNA, 13 bp, Artificial Sequence
  synthetic sequence
ttattgttattga

SEQ ID NO: 11828 - DNA, 13 bp, Artificial Sequence
  synthetic sequence
atctttcatatct

SEQ ID NO: 11829 - DNA, 13 bp, Artificial Sequence
  synthetic sequence
ggattatttttac

SEQ ID NO: 11830 - DNA, 13 bp, Artificial Sequence
  synthetic sequence
ctagtgtatatag

SEQ ID NO: 11831 - DNA, 13 bp, Artificial Sequence
  synthetic sequence
ttgtcatatgtta

SEQ ID NO: 11832 - DNA, 13 bp, Artificial Sequence
  synthetic sequence
tcatcaaagtcta

SEQ ID NO: 11833 - DNA, 13 bp, Artificial Sequence
  synthetic sequence
aattctctaaaca

SEQ ID NO: 11834 - DNA, 13 bp, Artificial Sequence
  synthetic sequence
ttctctgcttcat

SEQ ID NO: 11835 - DNA, 13 bp, Artificial Sequence
  synthetic sequence
tcatgagaatgta

SEQ ID NO: 11836 - DNA, 13 bp, Artificial Sequence
  synthetic sequence
aataattgtgctg

SEQ ID NO: 11837 - DNA, 13 bp, Artificial Sequence
  synthetic sequence
ctcccaaatttat

SEQ ID NO: 11838 - DNA, 13 bp, Artificial Sequence
  synthetic sequence
tatgaagccattc

SEQ ID NO: 11839 - DNA, 13 bp, Artificial Sequence
  synthetic sequence
tttattgttgcaa

SEQ ID NO: 11840 - DNA, 13 bp, Artificial Sequence
  synthetic sequence
tctcaaatatttt

SEQ ID NO: 11841 - DNA, 13 bp, Artificial Sequence
  synthetic sequence
agtatatttgtgt

SEQ ID NO: 11842 - DNA, 13 bp, Artificial Sequence
  synthetic sequence
atagtctttgcta

SEQ ID NO: 11843 - DNA, 13 bp, Artificial Sequence
  synthetic sequence
taagttgatatac

SEQ ID NO: 11844 - DNA, 13 bp, Artificial Sequence
  synthetic sequence
ctgttgtgaattt

SEQ ID NO: 11845 - DNA, 13 bp, Artificial Sequence
  synthetic sequence
ctgtactaatcat

SEQ ID NO: 11846 - DNA, 13 bp, Artificial Sequence
  synthetic sequence
ctttttagggaca

SEQ ID NO: 11847 - DNA, 13 bp, Artificial Sequence
  synthetic sequence
tcattttgcgact

SEQ ID NO: 11848 - DNA, 13 bp, Artificial Sequence
  synthetic sequence
ggcacctctcttt

SEQ ID NO: 11849 - DNA, 13 bp, Artificial Sequence
  synthetic sequence
atatctctaagtt

SEQ ID NO: 11850 - DNA, 13 bp, Artificial Sequence
  synthetic sequence
catcaattcagta

SEQ ID NO: 11851 - DNA, 13 bp, Artificial Sequence
  synthetic sequence
ttgcaaaatctat

SEQ ID NO: 11852 - DNA, 13 bp, Artificial Sequence
  synthetic sequence
cttttaatatttc

SEQ ID NO: 11853 - DNA, 13 bp, Artificial Sequence
  synthetic sequence
taaattctggcat

SEQ ID NO: 11854 - DNA, 13 bp, Artificial Sequence
  synthetic sequence
ttatttaccataa

SEQ ID NO: 11855 - DNA, 13 bp, Artificial Sequence
  synthetic sequence
atatttaaggact

SEQ ID NO: 11856 - DNA, 13 bp, Artificial Sequence
  synthetic sequence
tcaccgaattttt

SEQ ID NO: 11857 - DNA, 13 bp, Artificial Sequence
  synthetic sequence
gtcatccaatgac

SEQ ID NO: 11858 - DNA, 13 bp, Artificial Sequence
  synthetic sequence
gaataataattca

SEQ ID NO: 11859 - DNA, 13 bp, Artificial Sequence
  synthetic sequence
actaatctcattc

SEQ ID NO: 11860 - DNA, 13 bp, Artificial Sequence
  synthetic sequence
atttcttgttctg

SEQ ID NO: 11861 - DNA, 13 bp, Artificial Sequence
  synthetic sequence
tgactactgactc

SEQ ID NO: 11862 - DNA, 13 bp, Artificial Sequence
  synthetic sequence
gtattccatctct

SEQ ID NO: 11863 - DNA, 13 bp, Artificial Sequence
  synthetic sequence
aaatctctctgtg

SEQ ID NO: 11864 - DNA, 13 bp, Artificial Sequence
  synthetic sequence
tctctgctatata

SEQ ID NO: 11865 - DNA, 13 bp, Artificial Sequence
  synthetic sequence
cacaaggaatgga

SEQ ID NO: 11866 - DNA, 13 bp, Artificial Sequence
  synthetic sequence
ttacagggtctat

SEQ ID NO: 11867 - DNA, 13 bp, Artificial Sequence
  synthetic sequence
tctttataaatgg

SEQ ID NO: 11868 - DNA, 13 bp, Artificial Sequence
  synthetic sequence
gaaatagttgtta

SEQ ID NO: 11869 - DNA, 13 bp, Artificial Sequence
  synthetic sequence
gaataaattactt

SEQ ID NO: 11870 - DNA, 13 bp, Artificial Sequence
  synthetic sequence
caaactcttttat

SEQ ID NO: 11871 - DNA, 13 bp, Artificial Sequence
  synthetic sequence
tactatcatgtag

SEQ ID NO: 11872 - DNA, 13 bp, Artificial Sequence
  synthetic sequence
ttgtctaagtcag

SEQ ID NO: 11873 - DNA, 13 bp, Artificial Sequence
  synthetic sequence
tcatatttatcta

SEQ ID NO: 11874 - DNA, 13 bp, Artificial Sequence
  synthetic sequence
tctttctctaggg

SEQ ID NO: 11875 - DNA, 13 bp, Artificial Sequence
  synthetic sequence
atttgcatagctc

SEQ ID NO: 11876 - DNA, 13 bp, Artificial Sequence
  synthetic sequence
ttccagaattctg

SEQ ID NO: 11877 - DNA, 13 bp, Artificial Sequence
  synthetic sequence
aagaaacaattct

SEQ ID NO: 11878 - DNA, 13 bp, Artificial Sequence
  synthetic sequence
tatatatccctaa

SEQ ID NO: 11879 - DNA, 13 bp, Artificial Sequence
  synthetic sequence
acaaacattggat

SEQ ID NO: 11880 - DNA, 13 bp, Artificial Sequence
  synthetic sequence
tttctgattcata

SEQ ID NO: 11881 - DNA, 13 bp, Artificial Sequence
  synthetic sequence
aaatctctttgtg

SEQ ID NO: 11882 - DNA, 13 bp, Artificial Sequence
  synthetic sequence
gaaatggtggtta

SEQ ID NO: 11883 - DNA, 13 bp, Artificial Sequence
  synthetic sequence
tttattaagcata

SEQ ID NO: 11884 - DNA, 13 bp, Artificial Sequence
  synthetic sequence
gaaaatttctcag

SEQ ID NO: 11885 - DNA, 13 bp, Artificial Sequence
  synthetic sequence
ctggcattgttga

SEQ ID NO: 11886 - DNA, 13 bp, Artificial Sequence
  synthetic sequence
tgatcattgataa

SEQ ID NO: 11887 - DNA, 13 bp, Artificial Sequence
  synthetic sequence
agaagtcatccag

SEQ ID NO: 11888 - DNA, 13 bp, Artificial Sequence
  synthetic sequence
aatccactagcca

SEQ ID NO: 11889 - DNA, 13 bp, Artificial Sequence
  synthetic sequence
ccaagattctctg

SEQ ID NO: 11890 - DNA, 13 bp, Artificial Sequence
  synthetic sequence
accaagaaccgga

SEQ ID NO: 11891 - DNA, 13 bp, Artificial Sequence
  synthetic sequence
ccaactttaatcc

SEQ ID NO: 11892 - DNA, 13 bp, Artificial Sequence
  synthetic sequence
actgcctgctgtt

SEQ ID NO: 11893 - DNA, 13 bp, Artificial Sequence
  synthetic sequence
tatcaattcttta

SEQ ID NO: 11894 - DNA, 13 bp, Artificial Sequence
  synthetic sequence
atgttatagcctc

SEQ ID NO: 11895 - DNA, 13 bp, Artificial Sequence
  synthetic sequence
atttctcactttt

SEQ ID NO: 11896 - DNA, 13 bp, Artificial Sequence
  synthetic sequence
caggaagatcttg

SEQ ID NO: 11897 - DNA, 13 bp, Artificial Sequence
  synthetic sequence
agtatttgtaaaa

SEQ ID NO: 11898 - DNA, 13 bp, Artificial Sequence
  synthetic sequence
cttttcataaagt

SEQ ID NO: 11899 - DNA, 13 bp, Artificial Sequence
  synthetic sequence
gaagtatctgcaa

SEQ ID NO: 11900 - DNA, 13 bp, Artificial Sequence
  synthetic sequence
tatattacttgaa

SEQ ID NO: 11901 - DNA, 13 bp, Artificial Sequence
  synthetic sequence
gattgagtaaatc

SEQ ID NO: 11902 - DNA, 13 bp, Artificial Sequence
  synthetic sequence
ataccctttatgc

SEQ ID NO: 11903 - DNA, 13 bp, Artificial Sequence
  synthetic sequence
tgttcgcactcta

SEQ ID NO: 11904 - DNA, 13 bp, Artificial Sequence
  synthetic sequence
tctgattgaccac

SEQ ID NO: 11905 - DNA, 13 bp, Artificial Sequence
  synthetic sequence
atagcaattctga

SEQ ID NO: 11906 - DNA, 13 bp, Artificial Sequence
  synthetic sequence
aaattcttttata

SEQ ID NO: 11907 - DNA, 13 bp, Artificial Sequence
  synthetic sequence
tcatttatattat

SEQ ID NO: 11908 - DNA, 13 bp, Artificial Sequence
  synthetic sequence
ttacaggatctat

SEQ ID NO: 11909 - DNA, 13 bp, Artificial Sequence
  synthetic sequence
tgatatgtaaatc

SEQ ID NO: 11910 - DNA, 13 bp, Artificial Sequence
  synthetic sequence
tccttgaagccaa

SEQ ID NO: 11911 - DNA, 13 bp, Artificial Sequence
  synthetic sequence
gcaaagtctataa

SEQ ID NO: 11912 - DNA, 13 bp, Artificial Sequence
  synthetic sequence
tttgtgttaaata

SEQ ID NO: 11913 - DNA, 13 bp, Artificial Sequence
  synthetic sequence
ccctggtaaacta

SEQ ID NO: 11914 - DNA, 13 bp, Artificial Sequence
  synthetic sequence
cagatatgcattg

SEQ ID NO: 11915 - DNA, 13 bp, Artificial Sequence
  synthetic sequence
tacagtttgtaac

SEQ ID NO: 11916 - DNA, 13 bp, Artificial Sequence
  synthetic sequence
atacaaactggtg

SEQ ID NO: 11917 - DNA, 13 bp, Artificial Sequence
  synthetic sequence
aaggaatgaatca

SEQ ID NO: 11918 - DNA, 13 bp, Artificial Sequence
  synthetic sequence
tggattctgtatt

SEQ ID NO: 11919 - DNA, 13 bp, Artificial Sequence
  synthetic sequence
tgtcagggttatt

SEQ ID NO: 11920 - DNA, 13 bp, Artificial Sequence
  synthetic sequence
tcattggtcagtt

SEQ ID NO: 11921 - DNA, 13 bp, Artificial Sequence
  synthetic sequence
ttataacactgct

SEQ ID NO: 11922 - DNA, 13 bp, Artificial Sequence
  synthetic sequence
tagatctattgta

SEQ ID NO: 11923 - DNA, 13 bp, Artificial Sequence
  synthetic sequence
tttttgcatgact

SEQ ID NO: 11924 - DNA, 13 bp, Artificial Sequence
  synthetic sequence
caaaatctagtat

SEQ ID NO: 11925 - DNA, 13 bp, Artificial Sequence
  synthetic sequence
gtctaattgtcag

SEQ ID NO: 11926 - DNA, 13 bp, Artificial Sequence
  synthetic sequence
taatctgtataat

SEQ ID NO: 11927 - DNA, 13 bp, Artificial Sequence
  synthetic sequence
gttctgatttttg

SEQ ID NO: 11928 - DNA, 13 bp, Artificial Sequence
  synthetic sequence
cctttagtcacta

SEQ ID NO: 11929 - DNA, 13 bp, Artificial Sequence
  synthetic sequence
atctgagtatttt

SEQ ID NO: 11930 - DNA, 13 bp, Artificial Sequence
  synthetic sequence
ttcttcatcgtca

SEQ ID NO: 11931 - DNA, 13 bp, Artificial Sequence
  synthetic sequence
tggcttcaaccca

SEQ ID NO: 11932 - DNA, 13 bp, Artificial Sequence
  synthetic sequence
attcatctggcag

SEQ ID NO: 11933 - DNA, 13 bp, Artificial Sequence
  synthetic sequence
cttttgctatcct

SEQ ID NO: 11934 - DNA, 13 bp, Artificial Sequence
  synthetic sequence
tagagaaattcat

SEQ ID NO: 11935 - DNA, 13 bp, Artificial Sequence
  synthetic sequence
cagacaggaactc

SEQ ID NO: 11936 - DNA, 13 bp, Artificial Sequence
  synthetic sequence
tttctatcttctc

SEQ ID NO: 11937 - DNA, 13 bp, Artificial Sequence
  synthetic sequence
tatacaatttgtt

SEQ ID NO: 11938 - DNA, 13 bp, Artificial Sequence
  synthetic sequence
tttttatcaagca

SEQ ID NO: 11939 - DNA, 13 bp, Artificial Sequence
  synthetic sequence
gtaaggggaaaac

SEQ ID NO: 11940 - DNA, 13 bp, Artificial Sequence
  synthetic sequence
tgatgcgcaatgg

SEQ ID NO: 11941 - DNA, 13 bp, Artificial Sequence
  synthetic sequence
tgatgtgcccatt

SEQ ID NO: 11942 - DNA, 13 bp, Artificial Sequence
  synthetic sequence
atgatgccatctg

SEQ ID NO: 11943 - DNA, 13 bp, Artificial Sequence
  synthetic sequence
tttgttgttagca

SEQ ID NO: 11944 - DNA, 13 bp, Artificial Sequence
  synthetic sequence
tgaatgcaaatgc

SEQ ID NO: 11945 - DNA, 13 bp, Artificial Sequence
  synthetic sequence
cttgttagtgctg

SEQ ID NO: 11946 - DNA, 13 bp, Artificial Sequence
  synthetic sequence
aggacaaaaatgt

SEQ ID NO: 11947 - DNA, 13 bp, Artificial Sequence
  synthetic sequence
accaacatcatac

SEQ ID NO: 11948 - DNA, 13 bp, Artificial Sequence
  synthetic sequence
gaacccagaatgg

SEQ ID NO: 11949 - DNA, 13 bp, Artificial Sequence
  synthetic sequence
agtttgaagatta

SEQ ID NO: 11950 - DNA, 13 bp, Artificial Sequence
  synthetic sequence
tcagtgatgactt

SEQ ID NO: 11951 - DNA, 13 bp, Artificial Sequence
  synthetic sequence
gtgatgatgtggt

SEQ ID NO: 11952 - DNA, 13 bp, Artificial Sequence
  synthetic sequence
atgagctcaaaaa

SEQ ID NO: 11953 - DNA, 13 bp, Artificial Sequence
  synthetic sequence
ctgttgtgaatgc

SEQ ID NO: 11954 - DNA, 13 bp, Artificial Sequence
  synthetic sequence
tttgaaaatgcaa

SEQ ID NO: 11955 - DNA, 13 bp, Artificial Sequence
  synthetic sequence
ccaaaaagtgtgg

SEQ ID NO: 11956 - DNA, 13 bp, Artificial Sequence
  synthetic sequence
atcacaaaggaga

SEQ ID NO: 11957 - DNA, 13 bp, Artificial Sequence
  synthetic sequence
aacattacactgt

SEQ ID NO: 11958 - DNA, 13 bp, Artificial Sequence
  synthetic sequence
tgcatcgattcag

SEQ ID NO: 11959 - DNA, 13 bp, Artificial Sequence
  synthetic sequence
agtgtaaagagcc

SEQ ID NO: 11960 - DNA, 13 bp, Artificial Sequence
  synthetic sequence
cttctgattttta

SEQ ID NO: 11961 - DNA, 13 bp, Artificial Sequence
  synthetic sequence
ctcaaaaatggtg

SEQ ID NO: 11962 - DNA, 13 bp, Artificial Sequence
  synthetic sequence
gatcatgtcctga

SEQ ID NO: 11963 - DNA, 13 bp, Artificial Sequence
  synthetic sequence
aacagtatgaaaa

SEQ ID NO: 11964 - DNA, 13 bp, Artificial Sequence
  synthetic sequence
tctctagattggt

SEQ ID NO: 11965 - DNA, 13 bp, Artificial Sequence
  synthetic sequence
cagagacccatgg

SEQ ID NO: 11966 - DNA, 13 bp, Artificial Sequence
  synthetic sequence
agtttgaggatta

SEQ ID NO: 11967 - DNA, 13 bp, Artificial Sequence
  synthetic sequence
tcactttatttga

SEQ ID NO: 11968 - DNA, 13 bp, Artificial Sequence
  synthetic sequence
aatttagagacct

SEQ ID NO: 11969 - DNA, 13 bp, Artificial Sequence
  synthetic sequence
tattttgaaatgg

SEQ ID NO: 11970 - DNA, 13 bp, Artificial Sequence
  synthetic sequence
accactgttgaca

SEQ ID NO: 11971 - DNA, 13 bp, Artificial Sequence
  synthetic sequence
atgtttaggaatg

SEQ ID NO: 11972 - DNA, 13 bp, Artificial Sequence
  synthetic sequence
aatcagcttttca

SEQ ID NO: 11973 - DNA, 13 bp, Artificial Sequence
  synthetic sequence
gccagactggttc

SEQ ID NO: 11974 - DNA, 13 bp, Artificial Sequence
  synthetic sequence
caatcactcctga

SEQ ID NO: 11975 - DNA, 13 bp, Artificial Sequence
  synthetic sequence
atcaaaagcaggt

SEQ ID NO: 11976 - DNA, 13 bp, Artificial Sequence
  synthetic sequence
gaccccatgacca

SEQ ID NO: 11977 - DNA, 13 bp, Artificial Sequence
  synthetic sequence
gttctagaggtta

SEQ ID NO: 11978 - DNA, 13 bp, Artificial Sequence
  synthetic sequence
gcaggcatcacac

SEQ ID NO: 11979 - DNA, 13 bp, Artificial Sequence
  synthetic sequence
tcttcaaaggtga

SEQ ID NO: 11980 - DNA, 13 bp, Artificial Sequence
  synthetic sequence
agaacaacactga

SEQ ID NO: 11981 - DNA, 13 bp, Artificial Sequence
  synthetic sequence
gaaagcaattctg

SEQ ID NO: 11982 - DNA, 13 bp, Artificial Sequence
  synthetic sequence
aaggaattctctg

SEQ ID NO: 11983 - DNA, 13 bp, Artificial Sequence
  synthetic sequence
gacttttgaggaa

SEQ ID NO: 11984 - DNA, 13 bp, Artificial Sequence
  synthetic sequence
atcacacctgctg

SEQ ID NO: 11985 - DNA, 13 bp, Artificial Sequence
  synthetic sequence
aagaacaatgtgg

SEQ ID NO: 11986 - DNA, 13 bp, Artificial Sequence
  synthetic sequence
gaatactggatgg

SEQ ID NO: 11987 - DNA, 13 bp, Artificial Sequence
  synthetic sequence
tgattgacaattc

SEQ ID NO: 11988 - DNA, 13 bp, Artificial Sequence
  synthetic sequence
gggtgtttgggtc

SEQ ID NO: 11989 - DNA, 13 bp, Artificial Sequence
  synthetic sequence
cctgagagctcaa

SEQ ID NO: 11990 - DNA, 13 bp, Artificial Sequence
  synthetic sequence
atgactaactctg

SEQ ID NO: 11991 - DNA, 13 bp, Artificial Sequence
  synthetic sequence
tgaatcagttagc

SEQ ID NO: 11992 - DNA, 13 bp, Artificial Sequence
  synthetic sequence
tgttgctatagta

SEQ ID NO: 11993 - DNA, 13 bp, Artificial Sequence
  synthetic sequence
cttcttgagtgtt

SEQ ID NO: 11994 - DNA, 13 bp, Artificial Sequence
  synthetic sequence
acaaccacgacga

SEQ ID NO: 11995 - DNA, 13 bp, Artificial Sequence
  synthetic sequence
gaagaagagacaa

SEQ ID NO: 11996 - DNA, 13 bp, Artificial Sequence
  synthetic sequence
tggagaccaagga

SEQ ID NO: 11997 - DNA, 13 bp, Artificial Sequence
  synthetic sequence
ctccaggtgttaa

SEQ ID NO: 11998 - DNA, 13 bp, Artificial Sequence
  synthetic sequence
actagaaggagac

SEQ ID NO: 11999 - DNA, 13 bp, Artificial Sequence
  synthetic sequence
aaaggactacatc

SEQ ID NO: 12000 - DNA, 13 bp, Artificial Sequence
  synthetic sequence
aaagtaattctga

SEQ ID NO: 12001 - DNA, 13 bp, Artificial Sequence
  synthetic sequence
ccttgctgttgcg

SEQ ID NO: 12002 - DNA, 13 bp, Artificial Sequence
  synthetic sequence
gtatggactctat

SEQ ID NO: 12003 - DNA, 13 bp, Artificial Sequence
  synthetic sequence
agttttgagcact

SEQ ID NO: 12004 - DNA, 13 bp, Artificial Sequence
  synthetic sequence
ggttggatggctc

SEQ ID NO: 12005 - DNA, 13 bp, Artificial Sequence
  synthetic sequence
aagtcagctttcc

SEQ ID NO: 12006 - DNA, 13 bp, Artificial Sequence
  synthetic sequence
tttgccaagtaat

SEQ ID NO: 12007 - DNA, 13 bp, Artificial Sequence
  synthetic sequence
ggttcatcaacta

SEQ ID NO: 12008 - DNA, 13 bp, Artificial Sequence
  synthetic sequence
aaatctgtatatc

SEQ ID NO: 12009 - DNA, 13 bp, Artificial Sequence
  synthetic sequence
tgatgacaaatct

SEQ ID NO: 12010 - DNA, 13 bp, Artificial Sequence
  synthetic sequence
tagtagaggactt

SEQ ID NO: 12011 - DNA, 13 bp, Artificial Sequence
  synthetic sequence
tttataacagcag

SEQ ID NO: 12012 - DNA, 13 bp, Artificial Sequence
  synthetic sequence
tctttaagggtga

SEQ ID NO: 12013 - DNA, 13 bp, Artificial Sequence
  synthetic sequence
caaccccaggtgt

SEQ ID NO: 12014 - DNA, 13 bp, Artificial Sequence
  synthetic sequence
agcattacggact

SEQ ID NO: 12015 - DNA, 13 bp, Artificial Sequence
  synthetic sequence
accgtgatcatat

SEQ ID NO: 12016 - DNA, 13 bp, Artificial Sequence
  synthetic sequence
agaacactggacc

SEQ ID NO: 12017 - DNA, 13 bp, Artificial Sequence
  synthetic sequence
agaactggtgagc

SEQ ID NO: 12018 - DNA, 13 bp, Artificial Sequence
  synthetic sequence
atttcacctcagt

SEQ ID NO: 12019 - DNA, 13 bp, Artificial Sequence
  synthetic sequence
cagaagctcaccg

SEQ ID NO: 12020 - DNA, 13 bp, Artificial Sequence
  synthetic sequence
tgatttcctttta

SEQ ID NO: 12021 - DNA, 13 bp, Artificial Sequence
  synthetic sequence
tgcttaggttttt

SEQ ID NO: 12022 - DNA, 13 bp, Artificial Sequence
  synthetic sequence
cagtggactttac

SEQ ID NO: 12023 - DNA, 13 bp, Artificial Sequence
  synthetic sequence
ttgacccatcatg

SEQ ID NO: 12024 - DNA, 13 bp, Artificial Sequence
  synthetic sequence
aaacaggttcaaa

SEQ ID NO: 12025 - DNA, 13 bp, Artificial Sequence
  synthetic sequence
tttccttctatgc

SEQ ID NO: 12026 - DNA, 13 bp, Artificial Sequence
  synthetic sequence
tgccagattggtt

SEQ ID NO: 12027 - DNA, 13 bp, Artificial Sequence
  synthetic sequence
tctccttttatgc

SEQ ID NO: 12028 - DNA, 13 bp, Artificial Sequence
  synthetic sequence
ccaaaggcattta

SEQ ID NO: 12029 - DNA, 13 bp, Artificial Sequence
  synthetic sequence
ttaaaccatgtga

SEQ ID NO: 12030 - DNA, 13 bp, Artificial Sequence
  synthetic sequence
aatgtggaaaggc

SEQ ID NO: 12031 - DNA, 13 bp, Artificial Sequence
  synthetic sequence
aacgttaagtgca

SEQ ID NO: 12032 - DNA, 13 bp, Artificial Sequence
  synthetic sequence
ttgtgaagttgga

SEQ ID NO: 12033 - DNA, 13 bp, Artificial Sequence
  synthetic sequence
aagtattttgcca

SEQ ID NO: 12034 - DNA, 13 bp, Artificial Sequence
  synthetic sequence
caatgaccatcaa

SEQ ID NO: 12035 - DNA, 13 bp, Artificial Sequence
  synthetic sequence
agaaacaagtttt

SEQ ID NO: 12036 - DNA, 13 bp, Artificial Sequence
  synthetic sequence
atcaccttatttg

SEQ ID NO: 12037 - DNA, 13 bp, Artificial Sequence
  synthetic sequence
acaactgttactg

SEQ ID NO: 12038 - DNA, 13 bp, Artificial Sequence
  synthetic sequence
acaaacagcatga

SEQ ID NO: 12039 - DNA, 13 bp, Artificial Sequence
  synthetic sequence
ttgttaaccctaa

SEQ ID NO: 12040 - DNA, 13 bp, Artificial Sequence
  synthetic sequence
aaacagggaaaac

SEQ ID NO: 12041 - DNA, 13 bp, Artificial Sequence
  synthetic sequence
gtggaagattttg

SEQ ID NO: 12042 - DNA, 13 bp, Artificial Sequence
  synthetic sequence
ttcaaatctttga

SEQ ID NO: 12043 - DNA, 13 bp, Artificial Sequence
  synthetic sequence
aatatgagatgga

SEQ ID NO: 12044 - DNA, 13 bp, Artificial Sequence
  synthetic sequence
catcatcttcagg

SEQ ID NO: 12045 - DNA, 13 bp, Artificial Sequence
  synthetic sequence
attagacctctta

SEQ ID NO: 12046 - DNA, 13 bp, Artificial Sequence
  synthetic sequence
gtttttagcatga

SEQ ID NO: 12047 - DNA, 13 bp, Artificial Sequence
  synthetic sequence
cgtcatacacctc

SEQ ID NO: 12048 - DNA, 13 bp, Artificial Sequence
  synthetic sequence
cccatcagtaatg

SEQ ID NO: 12049 - DNA, 13 bp, Artificial Sequence
  synthetic sequence
ttgtcaaccctaa

SEQ ID NO: 12050 - DNA, 13 bp, Artificial Sequence
  synthetic sequence
agaacaaaaatgt

SEQ ID NO: 12051 - DNA, 13 bp, Artificial Sequence
  synthetic sequence
ctgagggtttgat

SEQ ID NO: 12052 - DNA, 13 bp, Artificial Sequence
  synthetic sequence
tttgaagattaca

SEQ ID NO: 12053 - DNA, 13 bp, Artificial Sequence
  synthetic sequence
aagtggaagaggg

SEQ ID NO: 12054 - DNA, 13 bp, Artificial Sequence
  synthetic sequence
agcggagcctata

SEQ ID NO: 12055 - DNA, 13 bp, Artificial Sequence
  synthetic sequence
cattgggttggtt

SEQ ID NO: 12056 - DNA, 13 bp, Artificial Sequence
  synthetic sequence
gaggactatatgg

SEQ ID NO: 12057 - DNA, 13 bp, Artificial Sequence
  synthetic sequence
cctgttgtgagtg

SEQ ID NO: 12058 - DNA, 13 bp, Artificial Sequence
  synthetic sequence
cctgttatgtatt

SEQ ID NO: 12059 - DNA, 13 bp, Artificial Sequence
  synthetic sequence
gttcagaatatct

SEQ ID NO: 12060 - DNA, 13 bp, Artificial Sequence
  synthetic sequence
tagcagaacctgt

SEQ ID NO: 12061 - DNA, 13 bp, Artificial Sequence
  synthetic sequence
aagtcagcctttc

SEQ ID NO: 12062 - DNA, 13 bp, Artificial Sequence
  synthetic sequence
aaaaggactacac

SEQ ID NO: 12063 - DNA, 13 bp, Artificial Sequence
  synthetic sequence
tgggacttagttt

SEQ ID NO: 12064 - DNA, 13 bp, Artificial Sequence
  synthetic sequence
aagagcttaaaat

SEQ ID NO: 12065 - DNA, 13 bp, Artificial Sequence
  synthetic sequence
gaatgtgtcatac

SEQ ID NO: 12066 - DNA, 13 bp, Artificial Sequence
  synthetic sequence
tttcacttcagct

SEQ ID NO: 12067 - DNA, 13 bp, Artificial Sequence
  synthetic sequence
tgcgatgatgtgg

SEQ ID NO: 12068 - DNA, 13 bp, Artificial Sequence
  synthetic sequence
ctcaagaatggtg

SEQ ID NO: 12069 - DNA, 13 bp, Artificial Sequence
  synthetic sequence
aggtgttttgcca

SEQ ID NO: 12070 - DNA, 13 bp, Artificial Sequence
  synthetic sequence
gtaaactgtatcc

SEQ ID NO: 12071 - DNA, 13 bp, Artificial Sequence
  synthetic sequence
gtcatcggttcca

SEQ ID NO: 12072 - DNA, 13 bp, Artificial Sequence
  synthetic sequence
aacgaggaatttt

SEQ ID NO: 12073 - DNA, 13 bp, Artificial Sequence
  synthetic sequence
tgattttgagagg

SEQ ID NO: 12074 - DNA, 13 bp, Artificial Sequence
  synthetic sequence
aggaacagaaaaa

SEQ ID NO: 12075 - DNA, 13 bp, Artificial Sequence
  synthetic sequence
aagtcaaaagttt

SEQ ID NO: 12076 - DNA, 13 bp, Artificial Sequence
  synthetic sequence
tttagagatcttt

SEQ ID NO: 12077 - DNA, 13 bp, Artificial Sequence
  synthetic sequence
agtcagttggcaa

SEQ ID NO: 12078 - DNA, 13 bp, Artificial Sequence
  synthetic sequence
tcatggattagat

SEQ ID NO: 12079 - DNA, 13 bp, Artificial Sequence
  synthetic sequence
gcgatttgctgca

SEQ ID NO: 12080 - DNA, 13 bp, Artificial Sequence
  synthetic sequence
agattctcttatt

SEQ ID NO: 12081 - DNA, 13 bp, Artificial Sequence
  synthetic sequence
aagcagagacacc

SEQ ID NO: 12082 - DNA, 13 bp, Artificial Sequence
  synthetic sequence
tttaaacttttgg

SEQ ID NO: 12083 - DNA, 13 bp, Artificial Sequence
  synthetic sequence
aagactttgatcc

SEQ ID NO: 12084 - DNA, 13 bp, Artificial Sequence
  synthetic sequence
tgcttcggttttt

SEQ ID NO: 12085 - DNA, 13 bp, Artificial Sequence
  synthetic sequence
gaattagtgagag

SEQ ID NO: 12086 - DNA, 13 bp, Artificial Sequence
  synthetic sequence
agagaatactttg

SEQ ID NO: 12087 - DNA, 13 bp, Artificial Sequence
  synthetic sequence
ggtgaggtggaca

SEQ ID NO: 12088 - DNA, 13 bp, Artificial Sequence
  synthetic sequence
tatatcagaaagg

SEQ ID NO: 12089 - DNA, 13 bp, Artificial Sequence
  synthetic sequence
gcacaaacttgtt

SEQ ID NO: 12090 - DNA, 13 bp, Artificial Sequence
  synthetic sequence
ctgagagttcgag

SEQ ID NO: 12091 - DNA, 13 bp, Artificial Sequence
  synthetic sequence
gttgagacaattc

SEQ ID NO: 12092 - DNA, 13 bp, Artificial Sequence
  synthetic sequence
ggtcatgtcctga

SEQ ID NO: 12093 - DNA, 13 bp, Artificial Sequence
  synthetic sequence
cccaggatggtgt

SEQ ID NO: 12094 - DNA, 13 bp, Artificial Sequence
  synthetic sequence
tgcctctgatttt

SEQ ID NO: 12095 - DNA, 13 bp, Artificial Sequence
  synthetic sequence
gattggctagatg

SEQ ID NO: 12096 - DNA, 13 bp, Artificial Sequence
  synthetic sequence
tcagaagcaggtt

SEQ ID NO: 12097 - DNA, 13 bp, Artificial Sequence
  synthetic sequence
gcagacccaaaaa

SEQ ID NO: 12098 - DNA, 13 bp, Artificial Sequence
  synthetic sequence
agaagaaagtcaa

SEQ ID NO: 12099 - DNA, 13 bp, Artificial Sequence
  synthetic sequence
gcatcaattggtt

SEQ ID NO: 12100 - DNA, 13 bp, Artificial Sequence
  synthetic sequence
tctagaatatgat

SEQ ID NO: 12101 - DNA, 13 bp, Artificial Sequence
  synthetic sequence
ttacatcaccttc

SEQ ID NO: 12102 - DNA, 13 bp, Artificial Sequence
  synthetic sequence
ggttgacagtgac

SEQ ID NO: 12103 - DNA, 13 bp, Artificial Sequence
  synthetic sequence
tgaacaccagaag

SEQ ID NO: 12104 - DNA, 13 bp, Artificial Sequence
  synthetic sequence
ctagaaggaaaca

SEQ ID NO: 12105 - DNA, 13 bp, Artificial Sequence
  synthetic sequence
caaagctggtctc

SEQ ID NO: 12106 - DNA, 13 bp, Artificial Sequence
  synthetic sequence
gtggatttcacac

SEQ ID NO: 12107 - DNA, 13 bp, Artificial Sequence
  synthetic sequence
actttgagaggat

SEQ ID NO: 12108 - DNA, 13 bp, Artificial Sequence
  synthetic sequence
gggtcttagcaga

SEQ ID NO: 12109 - DNA, 13 bp, Artificial Sequence
  synthetic sequence
agaaccgcatcaa

SEQ ID NO: 12110 - DNA, 13 bp, Artificial Sequence
  synthetic sequence
acaaattcatcag

SEQ ID NO: 12111 - DNA, 13 bp, Artificial Sequence
  synthetic sequence
aatcccttgattt

SEQ ID NO: 12112 - DNA, 13 bp, Artificial Sequence
  synthetic sequence
actttaaattcag

SEQ ID NO: 12113 - DNA, 13 bp, Artificial Sequence
  synthetic sequence
atgacaaacattg

SEQ ID NO: 12114 - DNA, 13 bp, Artificial Sequence
  synthetic sequence
ttgataagcgttc

SEQ ID NO: 12115 - DNA, 13 bp, Artificial Sequence
  synthetic sequence
ggacaaagagaac

SEQ ID NO: 12116 - DNA, 13 bp, Artificial Sequence
  synthetic sequence
aagtgcttgagga

SEQ ID NO: 12117 - DNA, 13 bp, Artificial Sequence
  synthetic sequence
cattcaaaggagg

SEQ ID NO: 12118 - DNA, 13 bp, Artificial Sequence
  synthetic sequence
tgatgtgtccatt

SEQ ID NO: 12119 - DNA, 13 bp, Artificial Sequence
  synthetic sequence
ctagaagacaagg

SEQ ID NO: 12120 - DNA, 13 bp, Artificial Sequence
  synthetic sequence
agtctgttgaaac

SEQ ID NO: 12121 - DNA, 13 bp, Artificial Sequence
  synthetic sequence
cattgggttggct

SEQ ID NO: 12122 - DNA, 13 bp, Artificial Sequence
  synthetic sequence
tggtaaactgcat

SEQ ID NO: 12123 - DNA, 13 bp, Artificial Sequence
  synthetic sequence
gataaggtgagtt

SEQ ID NO: 12124 - DNA, 13 bp, Artificial Sequence
  synthetic sequence
gtgatggccatag

SEQ ID NO: 12125 - DNA, 13 bp, Artificial Sequence
  synthetic sequence
aaagaagtattct

SEQ ID NO: 12126 - DNA, 13 bp, Artificial Sequence
  synthetic sequence
atgactttccaag

SEQ ID NO: 12127 - DNA, 13 bp, Artificial Sequence
  synthetic sequence
cctatgtttagaa

SEQ ID NO: 12128 - DNA, 13 bp, Artificial Sequence
  synthetic sequence
gttcatcacagca

SEQ ID NO: 12129 - DNA, 13 bp, Artificial Sequence
  synthetic sequence
aagtcaaacctga

SEQ ID NO: 12130 - DNA, 13 bp, Artificial Sequence
  synthetic sequence
acagcattaaaac

SEQ ID NO: 12131 - DNA, 13 bp, Artificial Sequence
  synthetic sequence
agtcgatctcctc

SEQ ID NO: 12132 - DNA, 13 bp, Artificial Sequence
  synthetic sequence
tcatcacttgatg

SEQ ID NO: 12133 - DNA, 13 bp, Artificial Sequence
  synthetic sequence
ggttggtgagcat

SEQ ID NO: 12134 - DNA, 13 bp, Artificial Sequence
  synthetic sequence
ggtaagagaacca

SEQ ID NO: 12135 - DNA, 13 bp, Artificial Sequence
  synthetic sequence
caacagcctcaca

SEQ ID NO: 12136 - DNA, 13 bp, Artificial Sequence
  synthetic sequence
cttgctacataat

SEQ ID NO: 12137 - DNA, 13 bp, Artificial Sequence
  synthetic sequence
caaaacattttat

SEQ ID NO: 12138 - DNA, 13 bp, Artificial Sequence
  synthetic sequence
cccagtcaaattt

SEQ ID NO: 12139 - DNA, 13 bp, Artificial Sequence
  synthetic sequence
gatcctcaaagat

SEQ ID NO: 12140 - DNA, 13 bp, Artificial Sequence
  synthetic sequence
gtgctaacatgat

SEQ ID NO: 12141 - DNA, 13 bp, Artificial Sequence
  synthetic sequence
ttatcataatcac

SEQ ID NO: 12142 - DNA, 13 bp, Artificial Sequence
  synthetic sequence
gcttctgtgcacc

SEQ ID NO: 12143 - DNA, 13 bp, Artificial Sequence
  synthetic sequence
ttcccccaacctg

SEQ ID NO: 12144 - DNA, 13 bp, Artificial Sequence
  synthetic sequence
ttgaaaactccaa

SEQ ID NO: 12145 - DNA, 13 bp, Artificial Sequence
  synthetic sequence
cctcatctgaaaa

SEQ ID NO: 12146 - DNA, 13 bp, Artificial Sequence
  synthetic sequence
aactttctacaaa

SEQ ID NO: 12147 - DNA, 13 bp, Artificial Sequence
  synthetic sequence
catcaggaatgat

SEQ ID NO: 12148 - DNA, 13 bp, Artificial Sequence
  synthetic sequence
tttgcactcaaca

SEQ ID NO: 12149 - DNA, 13 bp, Artificial Sequence
  synthetic sequence
gcctatcattcac

SEQ ID NO: 12150 - DNA, 13 bp, Artificial Sequence
  synthetic sequence
gttctccatttag

SEQ ID NO: 12151 - DNA, 13 bp, Artificial Sequence
  synthetic sequence
tcataatttcatc

SEQ ID NO: 12152 - DNA, 13 bp, Artificial Sequence
  synthetic sequence
gtctgcactgtct

SEQ ID NO: 12153 - DNA, 13 bp, Artificial Sequence
  synthetic sequence
gactctgagttga

SEQ ID NO: 12154 - DNA, 13 bp, Artificial Sequence
  synthetic sequence
aaatgaccttcct

SEQ ID NO: 12155 - DNA, 13 bp, Artificial Sequence
  synthetic sequence
cagcactcataca

SEQ ID NO: 12156 - DNA, 13 bp, Artificial Sequence
  synthetic sequence
ttagtgtcctcta

SEQ ID NO: 12157 - DNA, 13 bp, Artificial Sequence
  synthetic sequence
ctgaaaagaaact

SEQ ID NO: 12158 - DNA, 13 bp, Artificial Sequence
  synthetic sequence
tttctcacacacc

SEQ ID NO: 12159 - DNA, 13 bp, Artificial Sequence
  synthetic sequence
gagaggagcctct

SEQ ID NO: 12160 - DNA, 13 bp, Artificial Sequence
  synthetic sequence
acaaatgattcaa

SEQ ID NO: 12161 - DNA, 13 bp, Artificial Sequence
  synthetic sequence
ccacttgatacct

SEQ ID NO: 12162 - DNA, 13 bp, Artificial Sequence
  synthetic sequence
tgcaagattccct

SEQ ID NO: 12163 - DNA, 13 bp, Artificial Sequence
  synthetic sequence
cctttgaaaatta

SEQ ID NO: 12164 - DNA, 13 bp, Artificial Sequence
  synthetic sequence
cagactcttcaaa

SEQ ID NO: 12165 - DNA, 13 bp, Artificial Sequence
  synthetic sequence
tcatttgctcata

SEQ ID NO: 12166 - DNA, 13 bp, Artificial Sequence
  synthetic sequence
ctgtgttctttga

SEQ ID NO: 12167 - DNA, 13 bp, Artificial Sequence
  synthetic sequence
aatgatgtagatg

SEQ ID NO: 12168 - DNA, 13 bp, Artificial Sequence
  synthetic sequence
gattctccagtct

SEQ ID NO: 12169 - DNA, 13 bp, Artificial Sequence
  synthetic sequence
ttggtccccattt

SEQ ID NO: 12170 - DNA, 13 bp, Artificial Sequence
  synthetic sequence
agttgctcaatga

SEQ ID NO: 12171 - DNA, 13 bp, Artificial Sequence
  synthetic sequence
atatgacttcatc

SEQ ID NO: 12172 - DNA, 13 bp, Artificial Sequence
  synthetic sequence
atatgatttcatc

SEQ ID NO: 12173 - DNA, 13 bp, Artificial Sequence
  synthetic sequence
gagtctgtcctca

SEQ ID NO: 12174 - DNA, 13 bp, Artificial Sequence
  synthetic sequence
caaggtcagaaaa

SEQ ID NO: 12175 - DNA, 13 bp, Artificial Sequence
  synthetic sequence
ctcaaaaccattc

SEQ ID NO: 12176 - DNA, 13 bp, Artificial Sequence
  synthetic sequence
caattgtatctat

SEQ ID NO: 12177 - DNA, 13 bp, Artificial Sequence
  synthetic sequence
ttctccccacaca

SEQ ID NO: 12178 - DNA, 13 bp, Artificial Sequence
  synthetic sequence
gtgaagaaagaca

SEQ ID NO: 12179 - DNA, 13 bp, Artificial Sequence
  synthetic sequence
aacctttgtttca

SEQ ID NO: 12180 - DNA, 13 bp, Artificial Sequence
  synthetic sequence
tctgtaattggca

SEQ ID NO: 12181 - DNA, 13 bp, Artificial Sequence
  synthetic sequence
tgatatctcacag

SEQ ID NO: 12182 - DNA, 13 bp, Artificial Sequence
  synthetic sequence
tgagaagagggac

SEQ ID NO: 12183 - DNA, 13 bp, Artificial Sequence
  synthetic sequence
cctgagaagaaac

SEQ ID NO: 12184 - DNA, 13 bp, Artificial Sequence
  synthetic sequence
aacatttcattca

SEQ ID NO: 12185 - DNA, 13 bp, Artificial Sequence
  synthetic sequence
aagttctcaaatt

SEQ ID NO: 12186 - DNA, 13 bp, Artificial Sequence
  synthetic sequence
aatcaccaagtat

SEQ ID NO: 12187 - DNA, 13 bp, Artificial Sequence
  synthetic sequence
ctgctgaaaagag

SEQ ID NO: 12188 - DNA, 13 bp, Artificial Sequence
  synthetic sequence
catcagggatgat

SEQ ID NO: 12189 - DNA, 13 bp, Artificial Sequence
  synthetic sequence
tatacttttgttt

SEQ ID NO: 12190 - DNA, 13 bp, Artificial Sequence
  synthetic sequence
gtcatcattatca

SEQ ID NO: 12191 - DNA, 13 bp, Artificial Sequence
  synthetic sequence
caaagacctataa

SEQ ID NO: 12192 - DNA, 13 bp, Artificial Sequence
  synthetic sequence
tccatgctgtagt

SEQ ID NO: 12193 - DNA, 13 bp, Artificial Sequence
  synthetic sequence
attgtgtctattg

SEQ ID NO: 12194 - DNA, 13 bp, Artificial Sequence
  synthetic sequence
gtcccatgtcaat

SEQ ID NO: 12195 - DNA, 13 bp, Artificial Sequence
  synthetic sequence
gaggaaagacaca

SEQ ID NO: 12196 - DNA, 13 bp, Artificial Sequence
  synthetic sequence
gatgttttgaaca

SEQ ID NO: 12197 - DNA, 13 bp, Artificial Sequence
  synthetic sequence
atagatctgtcta

SEQ ID NO: 12198 - DNA, 13 bp, Artificial Sequence
  synthetic sequence
gatccaaagggaa

SEQ ID NO: 12199 - DNA, 13 bp, Artificial Sequence
  synthetic sequence
gaattgctcagtg

SEQ ID NO: 12200 - DNA, 13 bp, Artificial Sequence
  synthetic sequence
tcatagccctcaa

SEQ ID NO: 12201 - DNA, 13 bp, Artificial Sequence
  synthetic sequence
ctcccaattgaag

SEQ ID NO: 12202 - DNA, 13 bp, Artificial Sequence
  synthetic sequence
acctcttctgtac

SEQ ID NO: 12203 - DNA, 13 bp, Artificial Sequence
  synthetic sequence
ccttttcaccagt

SEQ ID NO: 12204 - DNA, 13 bp, Artificial Sequence
  synthetic sequence
gatgaaaagtctg

SEQ ID NO: 12205 - DNA, 13 bp, Artificial Sequence
  synthetic sequence
gacacaattcttc

SEQ ID NO: 12206 - DNA, 13 bp, Artificial Sequence
  synthetic sequence
ggtcaaggaattt

SEQ ID NO: 12207 - DNA, 13 bp, Artificial Sequence
  synthetic sequence
ttaacaagaatgg

SEQ ID NO: 12208 - DNA, 13 bp, Artificial Sequence
  synthetic sequence
ttctcaggctctg

SEQ ID NO: 12209 - DNA, 13 bp, Artificial Sequence
  synthetic sequence
tgatcttgcgtct

SEQ ID NO: 12210 - DNA, 13 bp, Artificial Sequence
  synthetic sequence
agaacatcaccaa

SEQ ID NO: 12211 - DNA, 13 bp, Artificial Sequence
  synthetic sequence
ccgattgcaaact

SEQ ID NO: 12212 - DNA, 13 bp, Artificial Sequence
  synthetic sequence
atcttccctgtta

SEQ ID NO: 12213 - DNA, 13 bp, Artificial Sequence
  synthetic sequence
ccgatctccctgt

SEQ ID NO: 12214 - DNA, 13 bp, Artificial Sequence
  synthetic sequence
ttttgcaatgaac

SEQ ID NO: 12215 - DNA, 13 bp, Artificial Sequence
  synthetic sequence
cttaatgttaaga

SEQ ID NO: 12216 - DNA, 13 bp, Artificial Sequence
  synthetic sequence
cacctttgagaca

SEQ ID NO: 12217 - DNA, 13 bp, Artificial Sequence
  synthetic sequence
aaggacttcctcc

SEQ ID NO: 12218 - DNA, 13 bp, Artificial Sequence
  synthetic sequence
tgaacttcttcat

SEQ ID NO: 12219 - DNA, 13 bp, Artificial Sequence
  synthetic sequence
tcacaaagtctga

SEQ ID NO: 12220 - DNA, 13 bp, Artificial Sequence
  synthetic sequence
gagaaaattggta

SEQ ID NO: 12221 - DNA, 13 bp, Artificial Sequence
  synthetic sequence
agtgctcctagat

SEQ ID NO: 12222 - DNA, 13 bp, Artificial Sequence
  synthetic sequence
ttctagttgttgc

SEQ ID NO: 12223 - DNA, 13 bp, Artificial Sequence
  synthetic sequence
tttcctccaacct

SEQ ID NO: 12224 - DNA, 13 bp, Artificial Sequence
  synthetic sequence
catctgctgggtc

SEQ ID NO: 12225 - DNA, 13 bp, Artificial Sequence
  synthetic sequence
ctatacaacgtga

SEQ ID NO: 12226 - DNA, 13 bp, Artificial Sequence
  synthetic sequence
tacttctgttttc

SEQ ID NO: 12227 - DNA, 13 bp, Artificial Sequence
  synthetic sequence
aactgttgtcata

SEQ ID NO: 12228 - DNA, 13 bp, Artificial Sequence
  synthetic sequence
agcctttcatact

SEQ ID NO: 12229 - DNA, 13 bp, Artificial Sequence
  synthetic sequence
gagactcacagag

SEQ ID NO: 12230 - DNA, 13 bp, Artificial Sequence
  synthetic sequence
aattcttcctttg

SEQ ID NO: 12231 - DNA, 13 bp, Artificial Sequence
  synthetic sequence
tgccattgttgaa

SEQ ID NO: 12232 - DNA, 13 bp, Artificial Sequence
  synthetic sequence
tgttggtgtcctc

SEQ ID NO: 12233 - DNA, 13 bp, Artificial Sequence
  synthetic sequence
tcaacagcttcac

SEQ ID NO: 12234 - DNA, 13 bp, Artificial Sequence
  synthetic sequence
catgcattttgtc

SEQ ID NO: 12235 - DNA, 13 bp, Artificial Sequence
  synthetic sequence
caactcttgaaga

SEQ ID NO: 12236 - DNA, 13 bp, Artificial Sequence
  synthetic sequence
acaaccacacttt

SEQ ID NO: 12237 - DNA, 13 bp, Artificial Sequence
  synthetic sequence
ttcttttctctat

SEQ ID NO: 12238 - DNA, 13 bp, Artificial Sequence
  synthetic sequence
acaaatgattgga

SEQ ID NO: 12239 - DNA, 13 bp, Artificial Sequence
  synthetic sequence
cattataccatca

SEQ ID NO: 12240 - DNA, 13 bp, Artificial Sequence
  synthetic sequence
accaatcaccctc

SEQ ID NO: 12241 - DNA, 13 bp, Artificial Sequence
  synthetic sequence
aggacttcttctg

SEQ ID NO: 12242 - DNA, 13 bp, Artificial Sequence
  synthetic sequence
caagtctcttctg

SEQ ID NO: 12243 - DNA, 13 bp, Artificial Sequence
  synthetic sequence
tgctgacatgatc

SEQ ID NO: 12244 - DNA, 13 bp, Artificial Sequence
  synthetic sequence
agacttgaatcag

SEQ ID NO: 12245 - DNA, 13 bp, Artificial Sequence
  synthetic sequence
attgagaactcca

SEQ ID NO: 12246 - DNA, 13 bp, Artificial Sequence
  synthetic sequence
ctctcaaattcag

SEQ ID NO: 12247 - DNA, 13 bp, Artificial Sequence
  synthetic sequence
ttattgtggagtt

SEQ ID NO: 12248 - DNA, 13 bp, Artificial Sequence
  synthetic sequence
ctattgaaaaggt

SEQ ID NO: 12249 - DNA, 13 bp, Artificial Sequence
  synthetic sequence
attctccagtttt

SEQ ID NO: 12250 - DNA, 13 bp, Artificial Sequence
  synthetic sequence
gcaacaaactctc

SEQ ID NO: 12251 - DNA, 13 bp, Artificial Sequence
  synthetic sequence
accactttcaaga

SEQ ID NO: 12252 - DNA, 13 bp, Artificial Sequence
  synthetic sequence
agtctgtctttaa

SEQ ID NO: 12253 - DNA, 13 bp, Artificial Sequence
  synthetic sequence
ataccggagctct

SEQ ID NO: 12254 - DNA, 13 bp, Artificial Sequence
  synthetic sequence
cttgagtctgacc

SEQ ID NO: 12255 - DNA, 13 bp, Artificial Sequence
  synthetic sequence
acattttgtcagt

SEQ ID NO: 12256 - DNA, 13 bp, Artificial Sequence
  synthetic sequence
ttcaaaatgaatg

SEQ ID NO: 12257 - DNA, 13 bp, Artificial Sequence
  synthetic sequence
caaaacactttat

SEQ ID NO: 12258 - DNA, 13 bp, Artificial Sequence
  synthetic sequence
tttcaaactctgt

SEQ ID NO: 12259 - DNA, 13 bp, Artificial Sequence
  synthetic sequence
ccaattcaagaga

SEQ ID NO: 12260 - DNA, 13 bp, Artificial Sequence
  synthetic sequence
tctgcttcctcat

SEQ ID NO: 12261 - DNA, 13 bp, Artificial Sequence
  synthetic sequence
aaactcagtgaat

SEQ ID NO: 12262 - DNA, 13 bp, Artificial Sequence
  synthetic sequence
agaatgaaattct

SEQ ID NO: 12263 - DNA, 13 bp, Artificial Sequence
  synthetic sequence
cttatacttatgc

SEQ ID NO: 12264 - DNA, 13 bp, Artificial Sequence
  synthetic sequence
aggtgtttaaagt

SEQ ID NO: 12265 - DNA, 13 bp, Artificial Sequence
  synthetic sequence
aaaccacttagat

SEQ ID NO: 12266 - DNA, 13 bp, Artificial Sequence
  synthetic sequence
tcagtattagtgt

SEQ ID NO: 12267 - DNA, 13 bp, Artificial Sequence
  synthetic sequence
cctcctaaacctg

SEQ ID NO: 12268 - DNA, 13 bp, Artificial Sequence
  synthetic sequence
gcacaggttccca

SEQ ID NO: 12269 - DNA, 13 bp, Artificial Sequence
  synthetic sequence
agtagctggtcct

SEQ ID NO: 12270 - DNA, 13 bp, Artificial Sequence
  synthetic sequence
cgagtatcaaggg

SEQ ID NO: 12271 - DNA, 13 bp, Artificial Sequence
  synthetic sequence
tctcattaatttt

SEQ ID NO: 12272 - DNA, 13 bp, Artificial Sequence
  synthetic sequence
agaatgtcatcat

SEQ ID NO: 12273 - DNA, 13 bp, Artificial Sequence
  synthetic sequence
actcatttatgga

SEQ ID NO: 12274 - DNA, 13 bp, Artificial Sequence
  synthetic sequence
tcccagtcaaact

SEQ ID NO: 12275 - DNA, 13 bp, Artificial Sequence
  synthetic sequence
tcaattgctctat

SEQ ID NO: 12276 - DNA, 13 bp, Artificial Sequence
  synthetic sequence
atctgtccatgca

SEQ ID NO: 12277 - DNA, 13 bp, Artificial Sequence
  synthetic sequence
atagcttgatcag

SEQ ID NO: 12278 - DNA, 13 bp, Artificial Sequence
  synthetic sequence
tcatttgttcata

SEQ ID NO: 12279 - DNA, 13 bp, Artificial Sequence
  synthetic sequence
ttctctcctttga

SEQ ID NO: 12280 - DNA, 13 bp, Artificial Sequence
  synthetic sequence
acttctgtgcacc

SEQ ID NO: 12281 - DNA, 13 bp, Artificial Sequence
  synthetic sequence
accaagtgtcaaa

SEQ ID NO: 12282 - DNA, 13 bp, Artificial Sequence
  synthetic sequence
ggaagttggcata

SEQ ID NO: 12283 - DNA, 13 bp, Artificial Sequence
  synthetic sequence
atcagtcgatttc

SEQ ID NO: 12284 - DNA, 13 bp, Artificial Sequence
  synthetic sequence
agatcagaaaata

SEQ ID NO: 12285 - DNA, 13 bp, Artificial Sequence
  synthetic sequence
aactctgcacatc

SEQ ID NO: 12286 - DNA, 13 bp, Artificial Sequence
  synthetic sequence
ctctatgaatttc

SEQ ID NO: 12287 - DNA, 13 bp, Artificial Sequence
  synthetic sequence
acatcacaccatc

SEQ ID NO: 12288 - DNA, 13 bp, Artificial Sequence
  synthetic sequence
tcaccacttttaa

SEQ ID NO: 12289 - DNA, 13 bp, Artificial Sequence
  synthetic sequence
tgtcacatgctca

SEQ ID NO: 12290 - DNA, 13 bp, Artificial Sequence
  synthetic sequence
agcctctcatact

SEQ ID NO: 12291 - DNA, 13 bp, Artificial Sequence
  synthetic sequence
gacacagaacatc

SEQ ID NO: 12292 - DNA, 13 bp, Artificial Sequence
  synthetic sequence
actctgagttaat

SEQ ID NO: 12293 - DNA, 13 bp, Artificial Sequence
  synthetic sequence
ataaaatctggat

SEQ ID NO: 12294 - DNA, 13 bp, Artificial Sequence
  synthetic sequence
atggaaacatctc

SEQ ID NO: 12295 - DNA, 13 bp, Artificial Sequence
  synthetic sequence
tcacaagttttct

SEQ ID NO: 12296 - DNA, 13 bp, Artificial Sequence
  synthetic sequence
tcttccttggtgc

SEQ ID NO: 12297 - DNA, 13 bp, Artificial Sequence
  synthetic sequence
gaacctctaagaa

SEQ ID NO: 12298 - DNA, 13 bp, Artificial Sequence
  synthetic sequence
gttgtctcataca

SEQ ID NO: 12299 - DNA, 13 bp, Artificial Sequence
  synthetic sequence
aagctcaagggag

SEQ ID NO: 12300 - DNA, 13 bp, Artificial Sequence
  synthetic sequence
gtatagagtaaca

SEQ ID NO: 12301 - DNA, 13 bp, Artificial Sequence
  synthetic sequence
aagaatttttcaa

SEQ ID NO: 12302 - DNA, 13 bp, Artificial Sequence
  synthetic sequence
aacatagcagcat

SEQ ID NO: 12303 - DNA, 13 bp, Artificial Sequence
  synthetic sequence
catatagtcccac

SEQ ID NO: 12304 - DNA, 13 bp, Artificial Sequence
  synthetic sequence
tttgaattcttgt

SEQ ID NO: 12305 - DNA, 13 bp, Artificial Sequence
  synthetic sequence
gtcataatcacaa

SEQ ID NO: 12306 - DNA, 13 bp, Artificial Sequence
  synthetic sequence
aaaaagctagaaa

SEQ ID NO: 12307 - DNA, 13 bp, Artificial Sequence
  synthetic sequence
ttttccatagccc

SEQ ID NO: 12308 - DNA, 13 bp, Artificial Sequence
  synthetic sequence
caaagtttgtttt

SEQ ID NO: 12309 - DNA, 13 bp, Artificial Sequence
  synthetic sequence
aattttggggtac

SEQ ID NO: 12310 - DNA, 13 bp, Artificial Sequence
  synthetic sequence
ctcaaaaagagca

SEQ ID NO: 12311 - DNA, 13 bp, Artificial Sequence
  synthetic sequence
ccttgccacataa

SEQ ID NO: 12312 - DNA, 13 bp, Artificial Sequence
  synthetic sequence
taaccttcaagtt

SEQ ID NO: 12313 - DNA, 13 bp, Artificial Sequence
  synthetic sequence
aggcattcatcca

SEQ ID NO: 12314 - DNA, 13 bp, Artificial Sequence
  synthetic sequence
acacctggacttt

SEQ ID NO: 12315 - DNA, 13 bp, Artificial Sequence
  synthetic sequence
cactcttgttgct

SEQ ID NO: 12316 - DNA, 13 bp, Artificial Sequence
  synthetic sequence
aaattctcaaact

SEQ ID NO: 12317 - DNA, 13 bp, Artificial Sequence
  synthetic sequence
tcagtgagatgca

SEQ ID NO: 12318 - DNA, 13 bp, Artificial Sequence
  synthetic sequence
tcatattcagtgc

SEQ ID NO: 12319 - DNA, 13 bp, Artificial Sequence
  synthetic sequence
gaataacaccttg

SEQ ID NO: 12320 - DNA, 13 bp, Artificial Sequence
  synthetic sequence
cccaatcaaatct

SEQ ID NO: 12321 - DNA, 13 bp, Artificial Sequence
  synthetic sequence
ttccctgccccat

SEQ ID NO: 12322 - DNA, 13 bp, Artificial Sequence
  synthetic sequence
acattatgccatc

SEQ ID NO: 12323 - DNA, 13 bp, Artificial Sequence
  synthetic sequence
tgaaatgcagatg

SEQ ID NO: 12324 - DNA, 13 bp, Artificial Sequence
  synthetic sequence
cttaaactctgca

SEQ ID NO: 12325 - DNA, 13 bp, Artificial Sequence
  synthetic sequence
ccctttagctggc

SEQ ID NO: 12326 - DNA, 13 bp, Artificial Sequence
  synthetic sequence
aagcctagaagga

SEQ ID NO: 12327 - DNA, 13 bp, Artificial Sequence
  synthetic sequence
tatgccttgcagg

SEQ ID NO: 12328 - DNA, 13 bp, Artificial Sequence
  synthetic sequence
ctaatggagggtc

SEQ ID NO: 12329 - DNA, 13 bp, Artificial Sequence
  synthetic sequence
aagccttgaggtc

SEQ ID NO: 12330 - DNA, 13 bp, Artificial Sequence
  synthetic sequence
ttctactcaattt

SEQ ID NO: 12331 - DNA, 13 bp, Artificial Sequence
  synthetic sequence
accgaatatccaa

SEQ ID NO: 12332 - DNA, 13 bp, Artificial Sequence
  synthetic sequence
tatcctatatacc

SEQ ID NO: 12333 - DNA, 13 bp, Artificial Sequence
  synthetic sequence
ccgctgtctcatt

SEQ ID NO: 12334 - DNA, 13 bp, Artificial Sequence
  synthetic sequence
attgtaagttgac

SEQ ID NO: 12335 - DNA, 13 bp, Artificial Sequence
  synthetic sequence
atcggagctataa

SEQ ID NO: 12336 - DNA, 13 bp, Artificial Sequence
  synthetic sequence
tgcagcaaattgg

SEQ ID NO: 12337 - DNA, 13 bp, Artificial Sequence
  synthetic sequence
cttccaattgcag

SEQ ID NO: 12338 - DNA, 13 bp, Artificial Sequence
  synthetic sequence
taagcaacatcac

SEQ ID NO: 12339 - DNA, 13 bp, Artificial Sequence
  synthetic sequence
tcttcgaagtgaa

SEQ ID NO: 12340 - DNA, 13 bp, Artificial Sequence
  synthetic sequence
tgaacaatatgtc

SEQ ID NO: 12341 - DNA, 13 bp, Artificial Sequence
  synthetic sequence
aatgcatccctcc

SEQ ID NO: 12342 - DNA, 13 bp, Artificial Sequence
  synthetic sequence
gcctagaaagata

SEQ ID NO: 12343 - DNA, 13 bp, Artificial Sequence
  synthetic sequence
ataaccagcttgc

SEQ ID NO: 12344 - DNA, 13 bp, Artificial Sequence
  synthetic sequence
taaggttaatgca

SEQ ID NO: 12345 - DNA, 13 bp, Artificial Sequence
  synthetic sequence
gaaggcacccaac

SEQ ID NO: 12346 - DNA, 13 bp, Artificial Sequence
  synthetic sequence
tggatttcagcat

SEQ ID NO: 12347 - DNA, 13 bp, Artificial Sequence
  synthetic sequence
aatattgcatcgc

SEQ ID NO: 12348 - DNA, 13 bp, Artificial Sequence
  synthetic sequence
tgtgtgaatatca

SEQ ID NO: 12349 - DNA, 13 bp, Artificial Sequence
  synthetic sequence
agaagaatcaact

SEQ ID NO: 12350 - DNA, 13 bp, Artificial Sequence
  synthetic sequence
ccttagttttgag

SEQ ID NO: 12351 - DNA, 13 bp, Artificial Sequence
  synthetic sequence
aactttgaaaata

SEQ ID NO: 12352 - DNA, 13 bp, Artificial Sequence
  synthetic sequence
gggaatgaacaat

SEQ ID NO: 12353 - DNA, 13 bp, Artificial Sequence
  synthetic sequence
gcagcacaagtaa

SEQ ID NO: 12354 - DNA, 13 bp, Artificial Sequence
  synthetic sequence
gtcaagcttttac

SEQ ID NO: 12355 - DNA, 13 bp, Artificial Sequence
  synthetic sequence
ctgtcgaagtcta

SEQ ID NO: 12356 - DNA, 13 bp, Artificial Sequence
  synthetic sequence
acaatcaaatgca

SEQ ID NO: 12357 - DNA, 13 bp, Artificial Sequence
  synthetic sequence
gcctagaatgaca

SEQ ID NO: 12358 - DNA, 13 bp, Artificial Sequence
  synthetic sequence
cggcattgtcacc

SEQ ID NO: 12359 - DNA, 13 bp, Artificial Sequence
  synthetic sequence
gcaggcaatatta

SEQ ID NO: 12360 - DNA, 13 bp, Artificial Sequence
  synthetic sequence
taagtttacaaga

SEQ ID NO: 12361 - DNA, 13 bp, Artificial Sequence
  synthetic sequence
aatcaccatgtta

SEQ ID NO: 12362 - DNA, 13 bp, Artificial Sequence
  synthetic sequence
tgatggtcaggtt

SEQ ID NO: 12363 - DNA, 13 bp, Artificial Sequence
  synthetic sequence
ttgcaacaattgt

SEQ ID NO: 12364 - DNA, 13 bp, Artificial Sequence
  synthetic sequence
aacactgttgtta

SEQ ID NO: 12365 - DNA, 13 bp, Artificial Sequence
  synthetic sequence
gaactttgtgagt

SEQ ID NO: 12366 - DNA, 13 bp, Artificial Sequence
  synthetic sequence
atctgcatctcat

SEQ ID NO: 12367 - DNA, 13 bp, Artificial Sequence
  synthetic sequence
cgtgcatttgtct

SEQ ID NO: 12368 - DNA, 13 bp, Artificial Sequence
  synthetic sequence
gtctgagacaatg

SEQ ID NO: 12369 - DNA, 13 bp, Artificial Sequence
  synthetic sequence
aagcccagcagca

SEQ ID NO: 12370 - DNA, 13 bp, Artificial Sequence
  synthetic sequence
ctctctgcctcat

SEQ ID NO: 12371 - DNA, 13 bp, Artificial Sequence
  synthetic sequence
taatagtattgat

SEQ ID NO: 12372 - DNA, 13 bp, Artificial Sequence
  synthetic sequence
tcttattgtattg

SEQ ID NO: 12373 - DNA, 13 bp, Artificial Sequence
  synthetic sequence
cagcaatgccaat

SEQ ID NO: 12374 - DNA, 13 bp, Artificial Sequence
  synthetic sequence
ttatgtacttaac

SEQ ID NO: 12375 - DNA, 13 bp, Artificial Sequence
  synthetic sequence
aattgaattatgg

SEQ ID NO: 12376 - DNA, 13 bp, Artificial Sequence
  synthetic sequence
tagataatgttgc

SEQ ID NO: 12377 - DNA, 13 bp, Artificial Sequence
  synthetic sequence
tttttctaaatct

SEQ ID NO: 12378 - DNA, 13 bp, Artificial Sequence
  synthetic sequence
agatcatcgacac

SEQ ID NO: 12379 - DNA, 13 bp, Artificial Sequence
  synthetic sequence
attcctgattatt

SEQ ID NO: 12380 - DNA, 13 bp, Artificial Sequence
  synthetic sequence
ggagttgatggtt

SEQ ID NO: 12381 - DNA, 13 bp, Artificial Sequence
  synthetic sequence
gcttgaaccactg

SEQ ID NO: 12382 - DNA, 13 bp, Artificial Sequence
  synthetic sequence
caaaccttttatg

SEQ ID NO: 12383 - DNA, 13 bp, Artificial Sequence
  synthetic sequence
tgagttacactct

SEQ ID NO: 12384 - DNA, 13 bp, Artificial Sequence
  synthetic sequence
atgcaggatgaat

SEQ ID NO: 12385 - DNA, 13 bp, Artificial Sequence
  synthetic sequence
cagaatgaatcac

SEQ ID NO: 12386 - DNA, 13 bp, Artificial Sequence
  synthetic sequence
tgatgtggtcttg

SEQ ID NO: 12387 - DNA, 13 bp, Artificial Sequence
  synthetic sequence
ggctcagcctctc

SEQ ID NO: 12388 - DNA, 13 bp, Artificial Sequence
  synthetic sequence
cttggaccactgc

SEQ ID NO: 12389 - DNA, 13 bp, Artificial Sequence
  synthetic sequence
ccgctattgcacg

SEQ ID NO: 12390 - DNA, 13 bp, Artificial Sequence
  synthetic sequence
caatgtaagccca

SEQ ID NO: 12391 - DNA, 13 bp, Artificial Sequence
  synthetic sequence
ttaggattagtac

SEQ ID NO: 12392 - DNA, 13 bp, Artificial Sequence
  synthetic sequence
ttgagtattgatt

SEQ ID NO: 12393 - DNA, 13 bp, Artificial Sequence
  synthetic sequence
ccaatttaaaatt

SEQ ID NO: 12394 - DNA, 13 bp, Artificial Sequence
  synthetic sequence
atatttatcttaa

SEQ ID NO: 12395 - DNA, 13 bp, Artificial Sequence
  synthetic sequence
taaatgcaggaag

SEQ ID NO: 12396 - DNA, 13 bp, Artificial Sequence
  synthetic sequence
gagtaatagctta

SEQ ID NO: 12397 - DNA, 13 bp, Artificial Sequence
  synthetic sequence
tcacagattggag

SEQ ID NO: 12398 - DNA, 13 bp, Artificial Sequence
  synthetic sequence
ttaattctgttag

SEQ ID NO: 12399 - DNA, 13 bp, Artificial Sequence
  synthetic sequence
gccaagtacagga

SEQ ID NO: 12400 - DNA, 13 bp, Artificial Sequence
  synthetic sequence
accagtatcagca

SEQ ID NO: 12401 - DNA, 13 bp, Artificial Sequence
  synthetic sequence
atatgaacaacat

SEQ ID NO: 12402 - DNA, 13 bp, Artificial Sequence
  synthetic sequence
ttaacaatagtgg

SEQ ID NO: 12403 - DNA, 13 bp, Artificial Sequence
  synthetic sequence
tcgtgggaagaag

SEQ ID NO: 12404 - DNA, 13 bp, Artificial Sequence
  synthetic sequence
ttgggcctggcaa

SEQ ID NO: 12405 - DNA, 13 bp, Artificial Sequence
  synthetic sequence
gaaagtggcaaat

SEQ ID NO: 12406 - DNA, 13 bp, Artificial Sequence
  synthetic sequence
agaggataagtgg

SEQ ID NO: 12407 - DNA, 13 bp, Artificial Sequence
  synthetic sequence
atactcattggac

SEQ ID NO: 12408 - DNA, 13 bp, Artificial Sequence
  synthetic sequence
tctgctactttta

SEQ ID NO: 12409 - DNA, 13 bp, Artificial Sequence
  synthetic sequence
cccagactgtacc

SEQ ID NO: 12410 - DNA, 13 bp, Artificial Sequence
  synthetic sequence
gtgaagaatcagc

SEQ ID NO: 12411 - DNA, 13 bp, Artificial Sequence
  synthetic sequence
gtggcttacatgg

SEQ ID NO: 12412 - DNA, 13 bp, Artificial Sequence
  synthetic sequence
ggtggtctgggat

SEQ ID NO: 12413 - DNA, 13 bp, Artificial Sequence
  synthetic sequence
ctttgtcaaaact

SEQ ID NO: 12414 - DNA, 13 bp, Artificial Sequence
  synthetic sequence
ctttagccccaga

SEQ ID NO: 12415 - DNA, 13 bp, Artificial Sequence
  synthetic sequence
ggctgctttttcc

SEQ ID NO: 12416 - DNA, 13 bp, Artificial Sequence
  synthetic sequence
cactgaaaccccg

SEQ ID NO: 12417 - DNA, 13 bp, Artificial Sequence
  synthetic sequence
agctgccatgtgg

SEQ ID NO: 12418 - DNA, 13 bp, Artificial Sequence
  synthetic sequence
tggagctatttag

SEQ ID NO: 12419 - DNA, 13 bp, Artificial Sequence
  synthetic sequence
aacaaatttgaag

SEQ ID NO: 12420 - DNA, 13 bp, Artificial Sequence
  synthetic sequence
attctgcagaagc

SEQ ID NO: 12421 - DNA, 13 bp, Artificial Sequence
  synthetic sequence
gaggggttattta

SEQ ID NO: 12422 - DNA, 13 bp, Artificial Sequence
  synthetic sequence
tgcaccattagtc

SEQ ID NO: 12423 - DNA, 13 bp, Artificial Sequence
  synthetic sequence
ggagagcagttta

SEQ ID NO: 12424 - DNA, 13 bp, Artificial Sequence
  synthetic sequence
ggtgacccaaaat

SEQ ID NO: 12425 - DNA, 13 bp, Artificial Sequence
  synthetic sequence
aatcctcaacctg

SEQ ID NO: 12426 - DNA, 13 bp, Artificial Sequence
  synthetic sequence
atttataaagcaa

SEQ ID NO: 12427 - DNA, 13 bp, Artificial Sequence
  synthetic sequence
gggtagatttcca

SEQ ID NO: 12428 - DNA, 13 bp, Artificial Sequence
  synthetic sequence
gacatggatatga

SEQ ID NO: 12429 - DNA, 13 bp, Artificial Sequence
  synthetic sequence
agttaaactttac

SEQ ID NO: 12430 - DNA, 13 bp, Artificial Sequence
  synthetic sequence
attttaagtgttt

SEQ ID NO: 12431 - DNA, 13 bp, Artificial Sequence
  synthetic sequence
aataaccttaaaa

SEQ ID NO: 12432 - DNA, 13 bp, Artificial Sequence
  synthetic sequence
atacagatcaaat

SEQ ID NO: 12433 - DNA, 13 bp, Artificial Sequence
  synthetic sequence
actaccttagttc

SEQ ID NO: 12434 - DNA, 13 bp, Artificial Sequence
  synthetic sequence
tcctccagtgccc

SEQ ID NO: 12435 - DNA, 13 bp, Artificial Sequence
  synthetic sequence
gcagaacctagag

SEQ ID NO: 12436 - DNA, 13 bp, Artificial Sequence
  synthetic sequence
gttgtgccattta

SEQ ID NO: 12437 - DNA, 13 bp, Artificial Sequence
  synthetic sequence
tagagtttcagca

SEQ ID NO: 12438 - DNA, 13 bp, Artificial Sequence
  synthetic sequence
gacaaaactggag

SEQ ID NO: 12439 - DNA, 13 bp, Artificial Sequence
  synthetic sequence
ctcagtttgcagc

SEQ ID NO: 12440 - DNA, 13 bp, Artificial Sequence
  synthetic sequence
agtgtagctgtgc

SEQ ID NO: 12441 - DNA, 13 bp, Artificial Sequence
  synthetic sequence
aaaggtgcagctg

SEQ ID NO: 12442 - DNA, 13 bp, Artificial Sequence
  synthetic sequence
tgggaaccactaa

SEQ ID NO: 12443 - DNA, 13 bp, Artificial Sequence
  synthetic sequence
aagccttaacagg

SEQ ID NO: 12444 - DNA, 13 bp, Artificial Sequence
  synthetic sequence
agcttattcaaat

SEQ ID NO: 12445 - DNA, 13 bp, Artificial Sequence
  synthetic sequence
cagataaatatgt

SEQ ID NO: 12446 - DNA, 13 bp, Artificial Sequence
  synthetic sequence
taattccatatga

SEQ ID NO: 12447 - DNA, 13 bp, Artificial Sequence
  synthetic sequence
tcatttcctgtga

SEQ ID NO: 12448 - DNA, 13 bp, Artificial Sequence
  synthetic sequence
tttggggctgaat

SEQ ID NO: 12449 - DNA, 13 bp, Artificial Sequence
  synthetic sequence
tgaaactttatgc

SEQ ID NO: 12450 - DNA, 13 bp, Artificial Sequence
  synthetic sequence
acagaaaagggat

SEQ ID NO: 12451 - DNA, 13 bp, Artificial Sequence
  synthetic sequence
aattccagggaaa

SEQ ID NO: 12452 - DNA, 13 bp, Artificial Sequence
  synthetic sequence
gttcctttattgg

SEQ ID NO: 12453 - DNA, 13 bp, Artificial Sequence
  synthetic sequence
tccacatgctttt

SEQ ID NO: 12454 - DNA, 13 bp, Artificial Sequence
  synthetic sequence
agaggatgggttt

SEQ ID NO: 12455 - DNA, 13 bp, Artificial Sequence
  synthetic sequence
catatgggtactt

SEQ ID NO: 12456 - DNA, 13 bp, Artificial Sequence
  synthetic sequence
tcattaaatggaa

SEQ ID NO: 12457 - DNA, 13 bp, Artificial Sequence
  synthetic sequence
tacatatggtaaa

SEQ ID NO: 12458 - DNA, 13 bp, Artificial Sequence
  synthetic sequence
acctgctcaaagt

SEQ ID NO: 12459 - DNA, 13 bp, Artificial Sequence
  synthetic sequence
accaagcccctac

SEQ ID NO: 12460 - DNA, 13 bp, Artificial Sequence
  synthetic sequence
tttctgaggcgtt

SEQ ID NO: 12461 - DNA, 13 bp, Artificial Sequence
  synthetic sequence
tacctcctgtacc

SEQ ID NO: 12462 - DNA, 13 bp, Artificial Sequence
  synthetic sequence
gagcaccaccagt

SEQ ID NO: 12463 - DNA, 13 bp, Artificial Sequence
  synthetic sequence
aaaagcccgctaa

SEQ ID NO: 12464 - DNA, 13 bp, Artificial Sequence
  synthetic sequence
agttcttcagagc

SEQ ID NO: 12465 - DNA, 13 bp, Artificial Sequence
  synthetic sequence
ataagggattgta

SEQ ID NO: 12466 - DNA, 13 bp, Artificial Sequence
  synthetic sequence
cttttgcagcttc

SEQ ID NO: 12467 - DNA, 13 bp, Artificial Sequence
  synthetic sequence
ggtagttgtacgc

SEQ ID NO: 12468 - DNA, 13 bp, Artificial Sequence
  synthetic sequence
gtggcacgtcaac

SEQ ID NO: 12469 - DNA, 13 bp, Artificial Sequence
  synthetic sequence
caatttctgatat

SEQ ID NO: 12470 - DNA, 13 bp, Artificial Sequence
  synthetic sequence
aaccccaactaac

SEQ ID NO: 12471 - DNA, 13 bp, Artificial Sequence
  synthetic sequence
tgcttgaaaccca

SEQ ID NO: 12472 - DNA, 13 bp, Artificial Sequence
  synthetic sequence
tttaaccctggcc

SEQ ID NO: 12473 - DNA, 13 bp, Artificial Sequence
  synthetic sequence
atctccatggggt

SEQ ID NO: 12474 - DNA, 13 bp, Artificial Sequence
  synthetic sequence
gctatacctaaag

SEQ ID NO: 12475 - DNA, 13 bp, Artificial Sequence
  synthetic sequence
tagctcacaaaaa

SEQ ID NO: 12476 - DNA, 13 bp, Artificial Sequence
  synthetic sequence
ttgtgttaggctg

SEQ ID NO: 12477 - DNA, 13 bp, Artificial Sequence
  synthetic sequence
cattcctggcaaa

SEQ ID NO: 12478 - DNA, 13 bp, Artificial Sequence
  synthetic sequence
tccatcaatatta

SEQ ID NO: 12479 - DNA, 13 bp, Artificial Sequence
  synthetic sequence
actttgaatttga

SEQ ID NO: 12480 - DNA, 13 bp, Artificial Sequence
  synthetic sequence
ctcctgaactggt

SEQ ID NO: 12481 - DNA, 13 bp, Artificial Sequence
  synthetic sequence
cccataaaaccac

SEQ ID NO: 12482 - DNA, 13 bp, Artificial Sequence
  synthetic sequence
ctttcatagtgaa

SEQ ID NO: 12483 - DNA, 13 bp, Artificial Sequence
  synthetic sequence
aaagtaatgtcac

SEQ ID NO: 12484 - DNA, 13 bp, Artificial Sequence
  synthetic sequence
actgtccatgact

SEQ ID NO: 12485 - DNA, 13 bp, Artificial Sequence
  synthetic sequence
acaaattgctgat

SEQ ID NO: 12486 - DNA, 13 bp, Artificial Sequence
  synthetic sequence
gtcttagtgtcaa

SEQ ID NO: 12487 - DNA, 13 bp, Artificial Sequence
  synthetic sequence
accccatgtcagg

SEQ ID NO: 12488 - DNA, 13 bp, Artificial Sequence
  synthetic sequence
tgtggcagctact

SEQ ID NO: 12489 - DNA, 13 bp, Artificial Sequence
  synthetic sequence
ccgttacaaaact

SEQ ID NO: 12490 - DNA, 13 bp, Artificial Sequence
  synthetic sequence
gtcaagcttagaa

SEQ ID NO: 12491 - DNA, 13 bp, Artificial Sequence
  synthetic sequence
gggccccaattta

SEQ ID NO: 12492 - DNA, 13 bp, Artificial Sequence
  synthetic sequence
catctcctactgt

SEQ ID NO: 12493 - DNA, 13 bp, Artificial Sequence
  synthetic sequence
gcccactttgtgg

SEQ ID NO: 12494 - DNA, 13 bp, Artificial Sequence
  synthetic sequence
tcatttatggctg

SEQ ID NO: 12495 - DNA, 13 bp, Artificial Sequence
  synthetic sequence
tctagtgttttga

SEQ ID NO: 12496 - DNA, 13 bp, Artificial Sequence
  synthetic sequence
agaaatggcattt

SEQ ID NO: 12497 - DNA, 13 bp, Artificial Sequence
  synthetic sequence
ttcagcgttacca

SEQ ID NO: 12498 - DNA, 13 bp, Artificial Sequence
  synthetic sequence
tgagaggttcctg

SEQ ID NO: 12499 - DNA, 13 bp, Artificial Sequence
  synthetic sequence
ggaagcacccttg

SEQ ID NO: 12500 - DNA, 13 bp, Artificial Sequence
  synthetic sequence
tggccatgacaga

SEQ ID NO: 12501 - DNA, 13 bp, Artificial Sequence
  synthetic sequence
gtgagtgactggc

SEQ ID NO: 12502 - DNA, 13 bp, Artificial Sequence
  synthetic sequence
tacgcgacactca

SEQ ID NO: 12503 - DNA, 13 bp, Artificial Sequence
  synthetic sequence
gcatctggaacaa

SEQ ID NO: 12504 - DNA, 13 bp, Artificial Sequence
  synthetic sequence
ggtcggatgaaca

SEQ ID NO: 12505 - DNA, 13 bp, Artificial Sequence
  synthetic sequence
tggtacatgtggc

SEQ ID NO: 12506 - DNA, 13 bp, Artificial Sequence
  synthetic sequence
accattggaggga

SEQ ID NO: 12507 - DNA, 13 bp, Artificial Sequence
  synthetic sequence
tggtggatgaaga

SEQ ID NO: 12508 - DNA, 13 bp, Artificial Sequence
  synthetic sequence
tcaatgtgctctc

SEQ ID NO: 12509 - DNA, 13 bp, Artificial Sequence
  synthetic sequence
gatgtggatggag

SEQ ID NO: 12510 - DNA, 13 bp, Artificial Sequence
  synthetic sequence
aatggaaagccag

SEQ ID NO: 12511 - DNA, 13 bp, Artificial Sequence
  synthetic sequence
ctcacggaattcc

SEQ ID NO: 12512 - DNA, 13 bp, Artificial Sequence
  synthetic sequence
aaggttgccaggc

SEQ ID NO: 12513 - DNA, 13 bp, Artificial Sequence
  synthetic sequence
tggtatgttcctc

SEQ ID NO: 12514 - DNA, 13 bp, Artificial Sequence
  synthetic sequence
gtacttcctgaat

SEQ ID NO: 12515 - DNA, 13 bp, Artificial Sequence
  synthetic sequence
tctgaaaagggta

SEQ ID NO: 12516 - DNA, 13 bp, Artificial Sequence
  synthetic sequence
ccatcacaaacat

SEQ ID NO: 12517 - DNA, 13 bp, Artificial Sequence
  synthetic sequence
actacagagacta

SEQ ID NO: 12518 - DNA, 13 bp, Artificial Sequence
  synthetic sequence
tggtttcgccata

SEQ ID NO: 12519 - DNA, 13 bp, Artificial Sequence
  synthetic sequence
tactggggcagct

SEQ ID NO: 12520 - DNA, 13 bp, Artificial Sequence
  synthetic sequence
gagcagacacaat

SEQ ID NO: 12521 - DNA, 13 bp, Artificial Sequence
  synthetic sequence
acaaggtgaaacc

SEQ ID NO: 12522 - DNA, 13 bp, Artificial Sequence
  synthetic sequence
cgagaccaggccc

SEQ ID NO: 12523 - DNA, 13 bp, Artificial Sequence
  synthetic sequence
cactgctggatgg

SEQ ID NO: 12524 - DNA, 13 bp, Artificial Sequence
  synthetic sequence
ggtcagtggagcc

SEQ ID NO: 12525 - DNA, 13 bp, Artificial Sequence
  synthetic sequence
tgggaagaagtgc

SEQ ID NO: 12526 - DNA, 13 bp, Artificial Sequence
  synthetic sequence
gtctcaactatct

SEQ ID NO: 12527 - DNA, 13 bp, Artificial Sequence
  synthetic sequence
ccaagctcgtgaa

SEQ ID NO: 12528 - DNA, 13 bp, Artificial Sequence
  synthetic sequence
accgctggctggg

SEQ ID NO: 12529 - DNA, 13 bp, Artificial Sequence
  synthetic sequence
gtggcggagcgca

SEQ ID NO: 12530 - DNA, 13 bp, Artificial Sequence
  synthetic sequence
ctgttcacatcac

SEQ ID NO: 12531 - DNA, 13 bp, Artificial Sequence
  synthetic sequence
ccatatgctctgc

SEQ ID NO: 12532 - DNA, 13 bp, Artificial Sequence
  synthetic sequence
ggggatcgggaca

SEQ ID NO: 12533 - DNA, 13 bp, Artificial Sequence
  synthetic sequence
ccgcactcctgcc

SEQ ID NO: 12534 - DNA, 13 bp, Artificial Sequence
  synthetic sequence
tgtgtgacatcgg

SEQ ID NO: 12535 - DNA, 13 bp, Artificial Sequence
  synthetic sequence
tggaaaaggtgag

SEQ ID NO: 12536 - DNA, 13 bp, Artificial Sequence
  synthetic sequence
acttgtgagggtc

SEQ ID NO: 12537 - DNA, 13 bp, Artificial Sequence
  synthetic sequence
aggatctggtgtg

SEQ ID NO: 12538 - DNA, 13 bp, Artificial Sequence
  synthetic sequence
ctgtacttcttga

SEQ ID NO: 12539 - DNA, 13 bp, Artificial Sequence
  synthetic sequence
aatggaaggccag

SEQ ID NO: 12540 - DNA, 13 bp, Artificial Sequence
  synthetic sequence
tcacgcaaaagtg

SEQ ID NO: 12541 - DNA, 13 bp, Artificial Sequence
  synthetic sequence
agaagcttggctg

SEQ ID NO: 12542 - DNA, 13 bp, Artificial Sequence
  synthetic sequence
ttggtgacatctg

SEQ ID NO: 12543 - DNA, 13 bp, Artificial Sequence
  synthetic sequence
gttggcagggcaa

SEQ ID NO: 12544 - DNA, 13 bp, Artificial Sequence
  synthetic sequence
gtggaaacctggc

SEQ ID NO: 12545 - DNA, 13 bp, Artificial Sequence
  synthetic sequence
ctatcagttcaca

SEQ ID NO: 12546 - DNA, 13 bp, Artificial Sequence
  synthetic sequence
tctagcttgagct

SEQ ID NO: 12547 - DNA, 13 bp, Artificial Sequence
  synthetic sequence
gttctccttccat

SEQ ID NO: 12548 - DNA, 13 bp, Artificial Sequence
  synthetic sequence
tctctttcccatc

SEQ ID NO: 12549 - DNA, 13 bp, Artificial Sequence
  synthetic sequence
ttccatcatgcgg

SEQ ID NO: 12550 - DNA, 13 bp, Artificial Sequence
  synthetic sequence
atgaccagccccc

SEQ ID NO: 12551 - DNA, 13 bp, Artificial Sequence
  synthetic sequence
ccatcccactcct

SEQ ID NO: 12552 - DNA, 13 bp, Artificial Sequence
  synthetic sequence
ttggacaggcagg

SEQ ID NO: 12553 - DNA, 13 bp, Artificial Sequence
  synthetic sequence
tcaaactcaagga

SEQ ID NO: 12554 - DNA, 13 bp, Artificial Sequence
  synthetic sequence
gggcctttgtgtc

SEQ ID NO: 12555 - DNA, 13 bp, Artificial Sequence
  synthetic sequence
gcacctggatggg

SEQ ID NO: 12556 - DNA, 13 bp, Artificial Sequence
  synthetic sequence
ttccatgtgaggg

SEQ ID NO: 12557 - DNA, 13 bp, Artificial Sequence
  synthetic sequence
tccatcacacatc

SEQ ID NO: 12558 - DNA, 13 bp, Artificial Sequence
  synthetic sequence
tacggggccaaca

SEQ ID NO: 12559 - DNA, 13 bp, Artificial Sequence
  synthetic sequence
gagggctcccact

SEQ ID NO: 12560 - DNA, 13 bp, Artificial Sequence
  synthetic sequence
cccagatgttctt

SEQ ID NO: 12561 - DNA, 13 bp, Artificial Sequence
  synthetic sequence
tccaaggccagct

SEQ ID NO: 12562 - DNA, 13 bp, Artificial Sequence
  synthetic sequence
catccttcatcac

SEQ ID NO: 12563 - DNA, 13 bp, Artificial Sequence
  synthetic sequence
actgcctcttttg

SEQ ID NO: 12564 - DNA, 13 bp, Artificial Sequence
  synthetic sequence
tcatctccactca

SEQ ID NO: 12565 - DNA, 13 bp, Artificial Sequence
  synthetic sequence
ccttctctggatc

SEQ ID NO: 12566 - DNA, 13 bp, Artificial Sequence
  synthetic sequence
tttcccgtgacgg

SEQ ID NO: 12567 - DNA, 13 bp, Artificial Sequence
  synthetic sequence
gcatggatgctcc

SEQ ID NO: 12568 - DNA, 13 bp, Artificial Sequence
  synthetic sequence
ttgttccttcagg

SEQ ID NO: 12569 - DNA, 13 bp, Artificial Sequence
  synthetic sequence
ggctcggctgtga

SEQ ID NO: 12570 - DNA, 13 bp, Artificial Sequence
  synthetic sequence
acctgccgccatc

SEQ ID NO: 12571 - DNA, 13 bp, Artificial Sequence
  synthetic sequence
ctttggtacacat

SEQ ID NO: 12572 - DNA, 13 bp, Artificial Sequence
  synthetic sequence
tactgttccctca

SEQ ID NO: 12573 - DNA, 13 bp, Artificial Sequence
  synthetic sequence
atactgccaaccc

SEQ ID NO: 12574 - DNA, 13 bp, Artificial Sequence
  synthetic sequence
tcattccaagttc

SEQ ID NO: 12575 - DNA, 13 bp, Artificial Sequence
  synthetic sequence
gaattaacaagat

SEQ ID NO: 12576 - DNA, 13 bp, Artificial Sequence
  synthetic sequence
gatgctccaagtg

SEQ ID NO: 12577 - DNA, 13 bp, Artificial Sequence
  synthetic sequence
atcactcttcggc

SEQ ID NO: 12578 - DNA, 13 bp, Artificial Sequence
  synthetic sequence
cactgcttctttc

SEQ ID NO: 12579 - DNA, 13 bp, Artificial Sequence
  synthetic sequence
tcgtctccactca

SEQ ID NO: 12580 - DNA, 13 bp, Artificial Sequence
  synthetic sequence
taaccatgcaagt

SEQ ID NO: 12581 - DNA, 13 bp, Artificial Sequence
  synthetic sequence
gtgacacggctaa

SEQ ID NO: 12582 - DNA, 13 bp, Artificial Sequence
  synthetic sequence
ttggcccattccg

SEQ ID NO: 12583 - DNA, 13 bp, Artificial Sequence
  synthetic sequence
catctttcatcac

SEQ ID NO: 12584 - DNA, 13 bp, Artificial Sequence
  synthetic sequence
tgagcgaagccgc

SEQ ID NO: 12585 - DNA, 13 bp, Artificial Sequence
  synthetic sequence
ttttgtgtcaact

SEQ ID NO: 12586 - DNA, 13 bp, Artificial Sequence
  synthetic sequence
gaaccttggccat

SEQ ID NO: 12587 - DNA, 13 bp, Artificial Sequence
  synthetic sequence
tgcgtgagtttcc

SEQ ID NO: 12588 - DNA, 13 bp, Artificial Sequence
  synthetic sequence
ccctaagatcaaa

SEQ ID NO: 12589 - DNA, 13 bp, Artificial Sequence
  synthetic sequence
gcagagaaagtcc

SEQ ID NO: 12590 - DNA, 13 bp, Artificial Sequence
  synthetic sequence
gctaatcagcttc

SEQ ID NO: 12591 - DNA, 13 bp, Artificial Sequence
  synthetic sequence
cattttgttacaa

SEQ ID NO: 12592 - DNA, 13 bp, Artificial Sequence
  synthetic sequence
agatggggagagc

SEQ ID NO: 12593 - DNA, 13 bp, Artificial Sequence
  synthetic sequence
gaagttccatggg

SEQ ID NO: 12594 - DNA, 13 bp, Artificial Sequence
  synthetic sequence
tggagatgaaagt

SEQ ID NO: 12595 - DNA, 13 bp, Artificial Sequence
  synthetic sequence
aactgctgggtga

SEQ ID NO: 12596 - DNA, 13 bp, Artificial Sequence
  synthetic sequence
gaatgcatgagtt

SEQ ID NO: 12597 - DNA, 13 bp, Artificial Sequence
  synthetic sequence
cttgctgggcctt

SEQ ID NO: 12598 - DNA, 13 bp, Artificial Sequence
  synthetic sequence
gatgatgatgaat

SEQ ID NO: 12599 - DNA, 13 bp, Artificial Sequence
  synthetic sequence
acaatgatctcag

SEQ ID NO: 12600 - DNA, 13 bp, Artificial Sequence
  synthetic sequence
caaacgttgagat

SEQ ID NO: 12601 - DNA, 13 bp, Artificial Sequence
  synthetic sequence
gtcagagcagccc

SEQ ID NO: 12602 - DNA, 13 bp, Artificial Sequence
  synthetic sequence
aagtggaatgacc

SEQ ID NO: 12603 - DNA, 13 bp, Artificial Sequence
  synthetic sequence
atgggtgcagagg

SEQ ID NO: 12604 - DNA, 13 bp, Artificial Sequence
  synthetic sequence
tacagagaccaga

SEQ ID NO: 12605 - DNA, 13 bp, Artificial Sequence
  synthetic sequence
agaagaggtcagg

SEQ ID NO: 12606 - DNA, 13 bp, Artificial Sequence
  synthetic sequence
attgagaggatgc

SEQ ID NO: 12607 - DNA, 13 bp, Artificial Sequence
  synthetic sequence
ggtgatcacgttg

SEQ ID NO: 12608 - DNA, 13 bp, Artificial Sequence
  synthetic sequence
tgaagaaggagct

SEQ ID NO: 12609 - DNA, 13 bp, Artificial Sequence
  synthetic sequence
gggcaacagatga

SEQ ID NO: 12610 - DNA, 13 bp, Artificial Sequence
  synthetic sequence
tgtcagacaagtg

SEQ ID NO: 12611 - DNA, 13 bp, Artificial Sequence
  synthetic sequence
caaataaattggt

SEQ ID NO: 12612 - DNA, 13 bp, Artificial Sequence
  synthetic sequence
atatcctggggtg

SEQ ID NO: 12613 - DNA, 13 bp, Artificial Sequence
  synthetic sequence
tagatgtggaaga

SEQ ID NO: 12614 - DNA, 13 bp, Artificial Sequence
  synthetic sequence
ggtgggtcattct

SEQ ID NO: 12615 - DNA, 13 bp, Artificial Sequence
  synthetic sequence
caacatttgatgt

SEQ ID NO: 12616 - DNA, 13 bp, Artificial Sequence
  synthetic sequence
agatattggatgc

SEQ ID NO: 12617 - DNA, 13 bp, Artificial Sequence
  synthetic sequence
ctgagttcaactt

SEQ ID NO: 12618 - DNA, 13 bp, Artificial Sequence
  synthetic sequence
cattccaggctgc

SEQ ID NO: 12619 - DNA, 13 bp, Artificial Sequence
  synthetic sequence
ataccagagaact

SEQ ID NO: 12620 - DNA, 13 bp, Artificial Sequence
  synthetic sequence
ctctttgggccag

SEQ ID NO: 12621 - DNA, 13 bp, Artificial Sequence
  synthetic sequence
cagaagcaactct

SEQ ID NO: 12622 - DNA, 13 bp, Artificial Sequence
  synthetic sequence
atccagaagtttg

SEQ ID NO: 12623 - DNA, 13 bp, Artificial Sequence
  synthetic sequence
aacctctgcaagt

SEQ ID NO: 12624 - DNA, 13 bp, Artificial Sequence
  synthetic sequence
atataatcatgga

SEQ ID NO: 12625 - DNA, 13 bp, Artificial Sequence
  synthetic sequence
gagaaactcatca

SEQ ID NO: 12626 - DNA, 13 bp, Artificial Sequence
  synthetic sequence
gagaattggtatg

SEQ ID NO: 12627 - DNA, 13 bp, Artificial Sequence
  synthetic sequence
cccagcatgttag

SEQ ID NO: 12628 - DNA, 13 bp, Artificial Sequence
  synthetic sequence
gaactgatttgca

SEQ ID NO: 12629 - DNA, 13 bp, Artificial Sequence
  synthetic sequence
atggatgagctaa

SEQ ID NO: 12630 - DNA, 13 bp, Artificial Sequence
  synthetic sequence
ctggaactttgtt

SEQ ID NO: 12631 - DNA, 13 bp, Artificial Sequence
  synthetic sequence
taaatcagtatag

SEQ ID NO: 12632 - DNA, 13 bp, Artificial Sequence
  synthetic sequence
tattaaactgctt

SEQ ID NO: 12633 - DNA, 13 bp, Artificial Sequence
  synthetic sequence
gagaggcttcatg

SEQ ID NO: 12634 - DNA, 13 bp, Artificial Sequence
  synthetic sequence
tcctgagacacat

SEQ ID NO: 12635 - DNA, 13 bp, Artificial Sequence
  synthetic sequence
catgtcaagccta

SEQ ID NO: 12636 - DNA, 13 bp, Artificial Sequence
  synthetic sequence
tacacaccattca

SEQ ID NO: 12637 - DNA, 13 bp, Artificial Sequence
  synthetic sequence
gggatgcaaccca

SEQ ID NO: 12638 - DNA, 13 bp, Artificial Sequence
  synthetic sequence
atctaatgataga

SEQ ID NO: 12639 - DNA, 13 bp, Artificial Sequence
  synthetic sequence
agataccatagag

SEQ ID NO: 12640 - DNA, 13 bp, Artificial Sequence
  synthetic sequence
ctttctgggatgt

SEQ ID NO: 12641 - DNA, 13 bp, Artificial Sequence
  synthetic sequence
tcactcgtagtgt

SEQ ID NO: 12642 - DNA, 13 bp, Artificial Sequence
  synthetic sequence
cagaaacgtgtag

SEQ ID NO: 12643 - DNA, 13 bp, Artificial Sequence
  synthetic sequence
gggatactatgct

SEQ ID NO: 12644 - DNA, 13 bp, Artificial Sequence
  synthetic sequence
atcataacagagc

SEQ ID NO: 12645 - DNA, 13 bp, Artificial Sequence
  synthetic sequence
tctttatgttgtt

SEQ ID NO: 12646 - DNA, 13 bp, Artificial Sequence
  synthetic sequence
acaggagtaaaca

SEQ ID NO: 12647 - DNA, 13 bp, Artificial Sequence
  synthetic sequence
ctccctggctgtc

SEQ ID NO: 12648 - DNA, 13 bp, Artificial Sequence
  synthetic sequence
ggagcaaatagac

SEQ ID NO: 12649 - DNA, 13 bp, Artificial Sequence
  synthetic sequence
tattcgagagctc

SEQ ID NO: 12650 - DNA, 13 bp, Artificial Sequence
  synthetic sequence
aaatgagagacag

SEQ ID NO: 12651 - DNA, 13 bp, Artificial Sequence
  synthetic sequence
gatggcaaagatc

SEQ ID NO: 12652 - DNA, 13 bp, Artificial Sequence
  synthetic sequence
aacagagcactac

SEQ ID NO: 12653 - DNA, 13 bp, Artificial Sequence
  synthetic sequence
gctagtattggaa

SEQ ID NO: 12654 - DNA, 13 bp, Artificial Sequence
  synthetic sequence
tatcggcatggtg

SEQ ID NO: 12655 - DNA, 13 bp, Artificial Sequence
  synthetic sequence
gatgaggatgtca

SEQ ID NO: 12656 - DNA, 13 bp, Artificial Sequence
  synthetic sequence
tatgatgcgttaa

SEQ ID NO: 12657 - DNA, 13 bp, Artificial Sequence
  synthetic sequence
caggtaccataga

SEQ ID NO: 12658 - DNA, 13 bp, Artificial Sequence
  synthetic sequence
actcgtagtgtgt

SEQ ID NO: 12659 - DNA, 13 bp, Artificial Sequence
  synthetic sequence
tcagagatgcaac

SEQ ID NO: 12660 - DNA, 13 bp, Artificial Sequence
  synthetic sequence
agactgagccttc

SEQ ID NO: 12661 - DNA, 13 bp, Artificial Sequence
  synthetic sequence
catggcatcaggg

SEQ ID NO: 12662 - DNA, 13 bp, Artificial Sequence
  synthetic sequence
aacatgttaagcc

SEQ ID NO: 12663 - DNA, 13 bp, Artificial Sequence
  synthetic sequence
cggtccttgtcct

SEQ ID NO: 12664 - DNA, 13 bp, Artificial Sequence
  synthetic sequence
atggagttgggat

SEQ ID NO: 12665 - DNA, 13 bp, Artificial Sequence
  synthetic sequence
tgacttgttcagg

SEQ ID NO: 12666 - DNA, 13 bp, Artificial Sequence
  synthetic sequence
cagaactgtcatc

SEQ ID NO: 12667 - DNA, 13 bp, Artificial Sequence
  synthetic sequence
tctcaggtcagag

SEQ ID NO: 12668 - DNA, 13 bp, Artificial Sequence
  synthetic sequence
gagtgttccttgg

SEQ ID NO: 12669 - DNA, 13 bp, Artificial Sequence
  synthetic sequence
tttaatctcttca

SEQ ID NO: 12670 - DNA, 13 bp, Artificial Sequence
  synthetic sequence
actccactgaata

SEQ ID NO: 12671 - DNA, 13 bp, Artificial Sequence
  synthetic sequence
aactgaagagttg

SEQ ID NO: 12672 - DNA, 13 bp, Artificial Sequence
  synthetic sequence
gaggattgcatga

SEQ ID NO: 12673 - DNA, 13 bp, Artificial Sequence
  synthetic sequence
attctcaagagaa

SEQ ID NO: 12674 - DNA, 13 bp, Artificial Sequence
  synthetic sequence
tagaccaacgatc

SEQ ID NO: 12675 - DNA, 13 bp, Artificial Sequence
  synthetic sequence
aactacacaaggg

SEQ ID NO: 12676 - DNA, 13 bp, Artificial Sequence
  synthetic sequence
aagcttactaacc

SEQ ID NO: 12677 - DNA, 13 bp, Artificial Sequence
  synthetic sequence
tctctttgggcct

SEQ ID NO: 12678 - DNA, 13 bp, Artificial Sequence
  synthetic sequence
acgtttgatgtct

SEQ ID NO: 12679 - DNA, 13 bp, Artificial Sequence
  synthetic sequence
gcactatgctagt

SEQ ID NO: 12680 - DNA, 13 bp, Artificial Sequence
  synthetic sequence
ttgctcatctcag

SEQ ID NO: 12681 - DNA, 13 bp, Artificial Sequence
  synthetic sequence
tgcatcatctgat

SEQ ID NO: 12682 - DNA, 13 bp, Artificial Sequence
  synthetic sequence
attcagatatgtg

SEQ ID NO: 12683 - DNA, 13 bp, Artificial Sequence
  synthetic sequence
tgctcattaaaga

SEQ ID NO: 12684 - DNA, 13 bp, Artificial Sequence
  synthetic sequence
cacaaagtcatct

SEQ ID NO: 12685 - DNA, 13 bp, Artificial Sequence
  synthetic sequence
tcatcttgtgagg

SEQ ID NO: 12686 - DNA, 13 bp, Artificial Sequence
  synthetic sequence
gagaaattgtcac

SEQ ID NO: 12687 - DNA, 13 bp, Artificial Sequence
  synthetic sequence
tctaattcctcaa

SEQ ID NO: 12688 - DNA, 13 bp, Artificial Sequence
  synthetic sequence
cagatgctccttg

SEQ ID NO: 12689 - DNA, 13 bp, Artificial Sequence
  synthetic sequence
ctagtgtttccac

SEQ ID NO: 12690 - DNA, 13 bp, Artificial Sequence
  synthetic sequence
gcttgctttccat

SEQ ID NO: 12691 - DNA, 13 bp, Artificial Sequence
  synthetic sequence
ggaacctcatact

SEQ ID NO: 12692 - DNA, 13 bp, Artificial Sequence
  synthetic sequence
ctgggcatccaaa

SEQ ID NO: 12693 - DNA, 13 bp, Artificial Sequence
  synthetic sequence
atgctgttgtttc

SEQ ID NO: 12694 - DNA, 13 bp, Artificial Sequence
  synthetic sequence
caaaatctgtgtt

SEQ ID NO: 12695 - DNA, 13 bp, Artificial Sequence
  synthetic sequence
gcagctgagccct

SEQ ID NO: 12696 - DNA, 13 bp, Artificial Sequence
  synthetic sequence
actctctctcagt

SEQ ID NO: 12697 - DNA, 13 bp, Artificial Sequence
  synthetic sequence
aagaacttcccta

SEQ ID NO: 12698 - DNA, 13 bp, Artificial Sequence
  synthetic sequence
tattttgacatct

SEQ ID NO: 12699 - DNA, 13 bp, Artificial Sequence
  synthetic sequence
gataatgaactga

SEQ ID NO: 12700 - DNA, 13 bp, Artificial Sequence
  synthetic sequence
agcatgtaatgga

SEQ ID NO: 12701 - DNA, 13 bp, Artificial Sequence
  synthetic sequence
ggttgtttgtgac

SEQ ID NO: 12702 - DNA, 13 bp, Artificial Sequence
  synthetic sequence
ctgggcctgttct

SEQ ID NO: 12703 - DNA, 13 bp, Artificial Sequence
  synthetic sequence
aaggatggctgat

SEQ ID NO: 12704 - DNA, 13 bp, Artificial Sequence
  synthetic sequence
gagcaccgacctg

SEQ ID NO: 12705 - DNA, 13 bp, Artificial Sequence
  synthetic sequence
tccctctcaaata

SEQ ID NO: 12706 - DNA, 13 bp, Artificial Sequence
  synthetic sequence
actgtggtctaag

SEQ ID NO: 12707 - DNA, 13 bp, Artificial Sequence
  synthetic sequence
gagaatggtgctt

SEQ ID NO: 12708 - DNA, 13 bp, Artificial Sequence
  synthetic sequence
agctaagtggcca

SEQ ID NO: 12709 - DNA, 13 bp, Artificial Sequence
  synthetic sequence
acaaatgagaaca

SEQ ID NO: 12710 - DNA, 13 bp, Artificial Sequence
  synthetic sequence
tggcttttgctgg

SEQ ID NO: 12711 - DNA, 13 bp, Artificial Sequence
  synthetic sequence
tatctgtctcttc

SEQ ID NO: 12712 - DNA, 13 bp, Artificial Sequence
  synthetic sequence
actgcattgccag

SEQ ID NO: 12713 - DNA, 13 bp, Artificial Sequence
  synthetic sequence
aacaacagctgat

SEQ ID NO: 12714 - DNA, 13 bp, Artificial Sequence
  synthetic sequence
tcccttcagcaaa

SEQ ID NO: 12715 - DNA, 13 bp, Artificial Sequence
  synthetic sequence
ttgtcaagcagga

SEQ ID NO: 12716 - DNA, 13 bp, Artificial Sequence
  synthetic sequence
gcttctttccatt

SEQ ID NO: 12717 - DNA, 13 bp, Artificial Sequence
  synthetic sequence
tcttcttaagaat

SEQ ID NO: 12718 - DNA, 13 bp, Artificial Sequence
  synthetic sequence
acttgtggtcatt

SEQ ID NO: 12719 - DNA, 13 bp, Artificial Sequence
  synthetic sequence
gcttcagagtcct

SEQ ID NO: 12720 - DNA, 13 bp, Artificial Sequence
  synthetic sequence
ttgggggctgtcc

SEQ ID NO: 12721 - DNA, 13 bp, Artificial Sequence
  synthetic sequence
gttgtctcttgat

SEQ ID NO: 12722 - DNA, 13 bp, Artificial Sequence
  synthetic sequence
gcatgtcatccgc

SEQ ID NO: 12723 - DNA, 13 bp, Artificial Sequence
  synthetic sequence
agctaagaattag

SEQ ID NO: 12724 - DNA, 13 bp, Artificial Sequence
  synthetic sequence
ttgaaaaccctgg

SEQ ID NO: 12725 - DNA, 13 bp, Artificial Sequence
  synthetic sequence
tgttgtacatgcc

SEQ ID NO: 12726 - DNA, 13 bp, Artificial Sequence
  synthetic sequence
gctgtagcttata

SEQ ID NO: 12727 - DNA, 13 bp, Artificial Sequence
  synthetic sequence
aatgcttctgccc

SEQ ID NO: 12728 - DNA, 13 bp, Artificial Sequence
  synthetic sequence
gggcaaactcaag

SEQ ID NO: 12729 - DNA, 13 bp, Artificial Sequence
  synthetic sequence
cccctaatgatca

SEQ ID NO: 12730 - DNA, 13 bp, Artificial Sequence
  synthetic sequence
agggttaataaag

SEQ ID NO: 12731 - DNA, 13 bp, Artificial Sequence
  synthetic sequence
ctttctagagtca

SEQ ID NO: 12732 - DNA, 13 bp, Artificial Sequence
  synthetic sequence
gttgtggtttcca

SEQ ID NO: 12733 - DNA, 13 bp, Artificial Sequence
  synthetic sequence
accatttggcacc

SEQ ID NO: 12734 - DNA, 13 bp, Artificial Sequence
  synthetic sequence
ttgcacatgggat

SEQ ID NO: 12735 - DNA, 13 bp, Artificial Sequence
  synthetic sequence
tgatatactctga

SEQ ID NO: 12736 - DNA, 13 bp, Artificial Sequence
  synthetic sequence
actttgcatctgg

SEQ ID NO: 12737 - DNA, 13 bp, Artificial Sequence
  synthetic sequence
aatctctgaagga

SEQ ID NO: 12738 - DNA, 13 bp, Artificial Sequence
  synthetic sequence
gattgcaagcctc

SEQ ID NO: 12739 - DNA, 13 bp, Artificial Sequence
  synthetic sequence
agcaagctgtact

SEQ ID NO: 12740 - DNA, 13 bp, Artificial Sequence
  synthetic sequence
taacatccaactc

SEQ ID NO: 12741 - DNA, 13 bp, Artificial Sequence
  synthetic sequence
tgcaattgacaac

SEQ ID NO: 12742 - DNA, 13 bp, Artificial Sequence
  synthetic sequence
ccatcttttgtag

SEQ ID NO: 12743 - DNA, 13 bp, Artificial Sequence
  synthetic sequence
gcttggcatgatt

SEQ ID NO: 12744 - DNA, 13 bp, Artificial Sequence
  synthetic sequence
atcccaatcaaat

SEQ ID NO: 12745 - DNA, 13 bp, Artificial Sequence
  synthetic sequence
cgggaggagaaga

SEQ ID NO: 12746 - DNA, 13 bp, Artificial Sequence
  synthetic sequence
aagcatatggctg

SEQ ID NO: 12747 - DNA, 13 bp, Artificial Sequence
  synthetic sequence
catctaatccctg

SEQ ID NO: 12748 - DNA, 13 bp, Artificial Sequence
  synthetic sequence
ccatttgacacca

SEQ ID NO: 12749 - DNA, 13 bp, Artificial Sequence
  synthetic sequence
ccttaagtgtggc

SEQ ID NO: 12750 - DNA, 13 bp, Artificial Sequence
  synthetic sequence
ctgcatcatccct

SEQ ID NO: 12751 - DNA, 13 bp, Artificial Sequence
  synthetic sequence
actcccgaaagag

SEQ ID NO: 12752 - DNA, 13 bp, Artificial Sequence
  synthetic sequence
ttgtcttccaaaa

SEQ ID NO: 12753 - DNA, 13 bp, Artificial Sequence
  synthetic sequence
tgatcagtggcca

SEQ ID NO: 12754 - DNA, 13 bp, Artificial Sequence
  synthetic sequence
cccaaaatgagaa

SEQ ID NO: 12755 - DNA, 13 bp, Artificial Sequence
  synthetic sequence
tacatgccagatg

SEQ ID NO: 12756 - DNA, 13 bp, Artificial Sequence
  synthetic sequence
tgtcattttctat

SEQ ID NO: 12757 - DNA, 13 bp, Artificial Sequence
  synthetic sequence
catctgtctcctc

SEQ ID NO: 12758 - DNA, 13 bp, Artificial Sequence
  synthetic sequence
atctaactctatg

SEQ ID NO: 12759 - DNA, 13 bp, Artificial Sequence
  synthetic sequence
tcctagatcccca

SEQ ID NO: 12760 - DNA, 13 bp, Artificial Sequence
  synthetic sequence
ctttagattgttg

SEQ ID NO: 12761 - DNA, 13 bp, Artificial Sequence
  synthetic sequence
aaagcagctatgt

SEQ ID NO: 12762 - DNA, 13 bp, Artificial Sequence
  synthetic sequence
acgcataagggtt

SEQ ID NO: 12763 - DNA, 13 bp, Artificial Sequence
  synthetic sequence
acctgctattctc

SEQ ID NO: 12764 - DNA, 13 bp, Artificial Sequence
  synthetic sequence
cctctgcttcaga

SEQ ID NO: 12765 - DNA, 13 bp, Artificial Sequence
  synthetic sequence
ccattgtaacaac

SEQ ID NO: 12766 - DNA, 13 bp, Artificial Sequence
  synthetic sequence
cttatagctctca

SEQ ID NO: 12767 - DNA, 13 bp, Artificial Sequence
  synthetic sequence
agcatctatgtag

SEQ ID NO: 12768 - DNA, 13 bp, Artificial Sequence
  synthetic sequence
ctaaggttgtctt

SEQ ID NO: 12769 - DNA, 13 bp, Artificial Sequence
  synthetic sequence
ccacaggttgcac

SEQ ID NO: 12770 - DNA, 13 bp, Artificial Sequence
  synthetic sequence
gaccaaaggtgaa

SEQ ID NO: 12771 - DNA, 13 bp, Artificial Sequence
  synthetic sequence
tagtctttgctgg

SEQ ID NO: 12772 - DNA, 13 bp, Artificial Sequence
  synthetic sequence
agacgcccagatg

SEQ ID NO: 12773 - DNA, 13 bp, Artificial Sequence
  synthetic sequence
ctgtgagctattc

SEQ ID NO: 12774 - DNA, 13 bp, Artificial Sequence
  synthetic sequence
ccagacctagatg

SEQ ID NO: 12775 - DNA, 13 bp, Artificial Sequence
  synthetic sequence
tcatggatggaca

SEQ ID NO: 12776 - DNA, 13 bp, Artificial Sequence
  synthetic sequence
atgtgcagtttag

SEQ ID NO: 12777 - DNA, 13 bp, Artificial Sequence
  synthetic sequence
gtggtggcagcag

SEQ ID NO: 12778 - DNA, 13 bp, Artificial Sequence
  synthetic sequence
caatgagatctac

SEQ ID NO: 12779 - DNA, 13 bp, Artificial Sequence
  synthetic sequence
tgctcttccctca

SEQ ID NO: 12780 - DNA, 13 bp, Artificial Sequence
  synthetic sequence
tggagggctttgt

SEQ ID NO: 12781 - DNA, 13 bp, Artificial Sequence
  synthetic sequence
agaaatcaacagt

SEQ ID NO: 12782 - DNA, 13 bp, Artificial Sequence
  synthetic sequence
atgttgacttcat

SEQ ID NO: 12783 - DNA, 13 bp, Artificial Sequence
  synthetic sequence
tctcctttgggaa

SEQ ID NO: 12784 - DNA, 13 bp, Artificial Sequence
  synthetic sequence
ctcagccactctg

SEQ ID NO: 12785 - DNA, 13 bp, Artificial Sequence
  synthetic sequence
atggcagccatac

SEQ ID NO: 12786 - DNA, 13 bp, Artificial Sequence
  synthetic sequence
gagggctacatgg

SEQ ID NO: 12787 - DNA, 13 bp, Artificial Sequence
  synthetic sequence
accactaggagcc

SEQ ID NO: 12788 - DNA, 13 bp, Artificial Sequence
  synthetic sequence
acattccatgcca

SEQ ID NO: 12789 - DNA, 13 bp, Artificial Sequence
  synthetic sequence
gagtaccataggt

SEQ ID NO: 12790 - DNA, 13 bp, Artificial Sequence
  synthetic sequence
gacttgcggtgca

SEQ ID NO: 12791 - DNA, 13 bp, Artificial Sequence
  synthetic sequence
tcttgttcatggt

SEQ ID NO: 12792 - DNA, 13 bp, Artificial Sequence
  synthetic sequence
ggcatggaaggca

SEQ ID NO: 12793 - DNA, 13 bp, Artificial Sequence
  synthetic sequence
cagagttcaaaag

SEQ ID NO: 12794 - DNA, 13 bp, Artificial Sequence
  synthetic sequence
tgtttgagcctaa

SEQ ID NO: 12795 - DNA, 13 bp, Artificial Sequence
  synthetic sequence
cctcattctctct

SEQ ID NO: 12796 - DNA, 13 bp, Artificial Sequence
  synthetic sequence
acttttcagatgt

SEQ ID NO: 12797 - DNA, 13 bp, Artificial Sequence
  synthetic sequence
catcagaggtcat

SEQ ID NO: 12798 - DNA, 13 bp, Artificial Sequence
  synthetic sequence
caaagataaccta

SEQ ID NO: 12799 - DNA, 13 bp, Artificial Sequence
  synthetic sequence
tgaacttcttccc

SEQ ID NO: 12800 - DNA, 13 bp, Artificial Sequence
  synthetic sequence
gatagatggagat

SEQ ID NO: 12801 - DNA, 13 bp, Artificial Sequence
  synthetic sequence
tctgatgggatga

SEQ ID NO: 12802 - DNA, 13 bp, Artificial Sequence
  synthetic sequence
atagatgagaatc

SEQ ID NO: 12803 - DNA, 13 bp, Artificial Sequence
  synthetic sequence
tatcagacccaga

SEQ ID NO: 12804 - DNA, 13 bp, Artificial Sequence
  synthetic sequence
aggtgtgtctgtg

SEQ ID NO: 12805 - DNA, 13 bp, Artificial Sequence
  synthetic sequence
ctgatcagttctg

SEQ ID NO: 12806 - DNA, 13 bp, Artificial Sequence
  synthetic sequence
gctgcttgctcat

SEQ ID NO: 12807 - DNA, 13 bp, Artificial Sequence
  synthetic sequence
gtgagttcatcat

SEQ ID NO: 12808 - DNA, 13 bp, Artificial Sequence
  synthetic sequence
gttcagagctcag

SEQ ID NO: 12809 - DNA, 13 bp, Artificial Sequence
  synthetic sequence
ccctggctaccaa

SEQ ID NO: 12810 - DNA, 13 bp, Artificial Sequence
  synthetic sequence
ggttcatgccagc

SEQ ID NO: 12811 - DNA, 13 bp, Artificial Sequence
  synthetic sequence
tagagaaccatgg

SEQ ID NO: 12812 - DNA, 13 bp, Artificial Sequence
  synthetic sequence
attgggaccaaga

SEQ ID NO: 12813 - DNA, 13 bp, Artificial Sequence
  synthetic sequence
gtgatgaccttgg

SEQ ID NO: 12814 - DNA, 13 bp, Artificial Sequence
  synthetic sequence
actcatgccctca

SEQ ID NO: 12815 - DNA, 13 bp, Artificial Sequence
  synthetic sequence
ctcctggcaaatg

SEQ ID NO: 12816 - DNA, 13 bp, Artificial Sequence
  synthetic sequence
tgatcacaatcca

SEQ ID NO: 12817 - DNA, 13 bp, Artificial Sequence
  synthetic sequence
tccgcaaggctga

SEQ ID NO: 12818 - DNA, 13 bp, Artificial Sequence
  synthetic sequence
agcaagccccaga

SEQ ID NO: 12819 - DNA, 13 bp, Artificial Sequence
  synthetic sequence
agctgtgggcaaa

SEQ ID NO: 12820 - DNA, 13 bp, Artificial Sequence
  synthetic sequence
ctaagctacaggt

SEQ ID NO: 12821 - DNA, 13 bp, Artificial Sequence
  synthetic sequence
aaggaagagtggg

SEQ ID NO: 12822 - DNA, 13 bp, Artificial Sequence
  synthetic sequence
aatagatgtgagg

SEQ ID NO: 12823 - DNA, 13 bp, Artificial Sequence
  synthetic sequence
aaatctcagagac

SEQ ID NO: 12824 - DNA, 13 bp, Artificial Sequence
  synthetic sequence
gtccagtcaggat

SEQ ID NO: 12825 - DNA, 13 bp, Artificial Sequence
  synthetic sequence
ctcacagagatgg

SEQ ID NO: 12826 - DNA, 13 bp, Artificial Sequence
  synthetic sequence
aacctctctgtca

SEQ ID NO: 12827 - DNA, 13 bp, Artificial Sequence
  synthetic sequence
ggagaaatgtata

SEQ ID NO: 12828 - DNA, 13 bp, Artificial Sequence
  synthetic sequence
attcgaggtatgg

SEQ ID NO: 12829 - DNA, 13 bp, Artificial Sequence
  synthetic sequence
gccctaagtcaga

SEQ ID NO: 12830 - DNA, 13 bp, Artificial Sequence
  synthetic sequence
ctcagttctaaat

SEQ ID NO: 12831 - DNA, 13 bp, Artificial Sequence
  synthetic sequence
gggtcttctttgg

SEQ ID NO: 12832 - DNA, 13 bp, Artificial Sequence
  synthetic sequence
agaaggctagcct

SEQ ID NO: 12833 - DNA, 13 bp, Artificial Sequence
  synthetic sequence
agtctcataaaac

SEQ ID NO: 12834 - DNA, 13 bp, Artificial Sequence
  synthetic sequence
tcgtcaggagggg

SEQ ID NO: 12835 - DNA, 13 bp, Artificial Sequence
  synthetic sequence
ctacagaccttgg

SEQ ID NO: 12836 - DNA, 13 bp, Artificial Sequence
  synthetic sequence
tcagacatggatg

SEQ ID NO: 12837 - DNA, 13 bp, Artificial Sequence
  synthetic sequence
aaatctgagtcta

SEQ ID NO: 12838 - DNA, 13 bp, Artificial Sequence
  synthetic sequence
cctaacattcaac

SEQ ID NO: 12839 - DNA, 13 bp, Artificial Sequence
  synthetic sequence
gaagattgtggag

SEQ ID NO: 12840 - DNA, 13 bp, Artificial Sequence
  synthetic sequence
atacaagaaggaa

SEQ ID NO: 12841 - DNA, 13 bp, Artificial Sequence
  synthetic sequence
catcaaggactga

SEQ ID NO: 12842 - DNA, 13 bp, Artificial Sequence
  synthetic sequence
ggctagagatcaa

SEQ ID NO: 12843 - DNA, 13 bp, Artificial Sequence
  synthetic sequence
atgaggtcaaagc

SEQ ID NO: 12844 - DNA, 13 bp, Artificial Sequence
  synthetic sequence
cctcctcaggaag

SEQ ID NO: 12845 - DNA, 13 bp, Artificial Sequence
  synthetic sequence
tctcaccaaatct

SEQ ID NO: 12846 - DNA, 13 bp, Artificial Sequence
  synthetic sequence
cttagggcctcat

SEQ ID NO: 12847 - DNA, 13 bp, Artificial Sequence
  synthetic sequence
gctgggcaatgtg

SEQ ID NO: 12848 - DNA, 13 bp, Artificial Sequence
  synthetic sequence
acgtgacaaggag

SEQ ID NO: 12849 - DNA, 13 bp, Artificial Sequence
  synthetic sequence
agaggaacctaag

SEQ ID NO: 12850 - DNA, 13 bp, Artificial Sequence
  synthetic sequence
tccgaaggttatg

SEQ ID NO: 12851 - DNA, 13 bp, Artificial Sequence
  synthetic sequence
actctaggaggct

SEQ ID NO: 12852 - DNA, 13 bp, Artificial Sequence
  synthetic sequence
aatgataggaaga

SEQ ID NO: 12853 - DNA, 13 bp, Artificial Sequence
  synthetic sequence
ccatcaagtgagt

SEQ ID NO: 12854 - DNA, 13 bp, Artificial Sequence
  synthetic sequence
aactcagagagca

SEQ ID NO: 12855 - DNA, 13 bp, Artificial Sequence
  synthetic sequence
gtcctgagagaga

SEQ ID NO: 12856 - DNA, 13 bp, Artificial Sequence
  synthetic sequence
ctctagttctttg

SEQ ID NO: 12857 - DNA, 13 bp, Artificial Sequence
  synthetic sequence
tccagctctctga

SEQ ID NO: 12858 - DNA, 13 bp, Artificial Sequence
  synthetic sequence
tgttcaaattctg

SEQ ID NO: 12859 - DNA, 13 bp, Artificial Sequence
  synthetic sequence
ccccattacccat

SEQ ID NO: 12860 - DNA, 13 bp, Artificial Sequence
  synthetic sequence
tcttgatgaagag

SEQ ID NO: 12861 - DNA, 13 bp, Artificial Sequence
  synthetic sequence
ctaggtgtgtttg

SEQ ID NO: 12862 - DNA, 13 bp, Artificial Sequence
  synthetic sequence
tctcacggagctt

SEQ ID NO: 12863 - DNA, 13 bp, Artificial Sequence
  synthetic sequence
catgggctaaagt

SEQ ID NO: 12864 - DNA, 13 bp, Artificial Sequence
  synthetic sequence
gcagggctggtga

SEQ ID NO: 12865 - DNA, 13 bp, Artificial Sequence
  synthetic sequence
atagatgagaacc

SEQ ID NO: 12866 - DNA, 13 bp, Artificial Sequence
  synthetic sequence
tggggatgctgat

SEQ ID NO: 12867 - DNA, 13 bp, Artificial Sequence
  synthetic sequence
aaggaccatgact

SEQ ID NO: 12868 - DNA, 13 bp, Artificial Sequence
  synthetic sequence
tccaagagccagt

SEQ ID NO: 12869 - DNA, 13 bp, Artificial Sequence
  synthetic sequence
cagttctggatga

SEQ ID NO: 12870 - DNA, 13 bp, Artificial Sequence
  synthetic sequence
cacagaaggccag

SEQ ID NO: 12871 - DNA, 13 bp, Artificial Sequence
  synthetic sequence
ctcagagggatca

SEQ ID NO: 12872 - DNA, 13 bp, Artificial Sequence
  synthetic sequence
agagtggaaggaa

SEQ ID NO: 12873 - DNA, 13 bp, Artificial Sequence
  synthetic sequence
gcagcatatagga

SEQ ID NO: 12874 - DNA, 13 bp, Artificial Sequence
  synthetic sequence
gtcttgaatggcc

SEQ ID NO: 12875 - DNA, 13 bp, Artificial Sequence
  synthetic sequence
ggaggaacattcc

SEQ ID NO: 12876 - DNA, 13 bp, Artificial Sequence
  synthetic sequence
tctcttacctacc

SEQ ID NO: 12877 - DNA, 13 bp, Artificial Sequence
  synthetic sequence
cccaaagaggcaa

SEQ ID NO: 12878 - DNA, 13 bp, Artificial Sequence
  synthetic sequence
tgctggagaagat

SEQ ID NO: 12879 - DNA, 13 bp, Artificial Sequence
  synthetic sequence
gaagacatgcaag

SEQ ID NO: 12880 - DNA, 13 bp, Artificial Sequence
  synthetic sequence
ggttttagcctag

SEQ ID NO: 12881 - DNA, 13 bp, Artificial Sequence
  synthetic sequence
aatccagctctca

SEQ ID NO: 12882 - DNA, 13 bp, Artificial Sequence
  synthetic sequence
gctgatgaggtct

SEQ ID NO: 12883 - DNA, 13 bp, Artificial Sequence
  synthetic sequence
agatcttaaggaa

SEQ ID NO: 12884 - DNA, 13 bp, Artificial Sequence
  synthetic sequence
ttctctctccaga

SEQ ID NO: 12885 - DNA, 13 bp, Artificial Sequence
  synthetic sequence
tctgtcattgctt

SEQ ID NO: 12886 - DNA, 13 bp, Artificial Sequence
  synthetic sequence
cagatccagctgc

SEQ ID NO: 12887 - DNA, 13 bp, Artificial Sequence
  synthetic sequence
caaaccacacctc

SEQ ID NO: 12888 - DNA, 13 bp, Artificial Sequence
  synthetic sequence
gctcctctgcctc

SEQ ID NO: 12889 - DNA, 13 bp, Artificial Sequence
  synthetic sequence
tcttgcctgcttg

SEQ ID NO: 12890 - DNA, 13 bp, Artificial Sequence
  synthetic sequence
tctcctcagtctt

SEQ ID NO: 12891 - DNA, 13 bp, Artificial Sequence
  synthetic sequence
gcctcaagctctt

SEQ ID NO: 12892 - DNA, 13 bp, Artificial Sequence
  synthetic sequence
ccatcatcttttt

SEQ ID NO: 12893 - DNA, 13 bp, Artificial Sequence
  synthetic sequence
tccacttcttggc

SEQ ID NO: 12894 - DNA, 13 bp, Artificial Sequence
  synthetic sequence
ccaatgtaccagc

SEQ ID NO: 12895 - DNA, 13 bp, Artificial Sequence
  synthetic sequence
gtatgccctgcat

SEQ ID NO: 12896 - DNA, 13 bp, Artificial Sequence
  synthetic sequence
gattgggtcccta

SEQ ID NO: 12897 - DNA, 13 bp, Artificial Sequence
  synthetic sequence
cacacattgtgat

SEQ ID NO: 12898 - DNA, 13 bp, Artificial Sequence
  synthetic sequence
tccacagattgaa

SEQ ID NO: 12899 - DNA, 13 bp, Artificial Sequence
  synthetic sequence
gcatggcagatgc

SEQ ID NO: 12900 - DNA, 13 bp, Artificial Sequence
  synthetic sequence
cagaccacaagat

SEQ ID NO: 12901 - DNA, 13 bp, Artificial Sequence
  synthetic sequence
ttcatggcagaaa

SEQ ID NO: 12902 - DNA, 13 bp, Artificial Sequence
  synthetic sequence
ttaccctgtatct

SEQ ID NO: 12903 - DNA, 13 bp, Artificial Sequence
  synthetic sequence
catatgcgccatg

SEQ ID NO: 12904 - DNA, 13 bp, Artificial Sequence
  synthetic sequence
atcttttggggct

SEQ ID NO: 12905 - DNA, 13 bp, Artificial Sequence
  synthetic sequence
gggtctgtgctca

SEQ ID NO: 12906 - DNA, 13 bp, Artificial Sequence
  synthetic sequence
gaagcatgtagtg

SEQ ID NO: 12907 - DNA, 13 bp, Artificial Sequence
  synthetic sequence
tctcaatcaatgt

SEQ ID NO: 12908 - DNA, 13 bp, Artificial Sequence
  synthetic sequence
tcccattccccag

SEQ ID NO: 12909 - DNA, 13 bp, Artificial Sequence
  synthetic sequence
gctttaggtagtg

SEQ ID NO: 12910 - DNA, 13 bp, Artificial Sequence
  synthetic sequence
cacataatggtgc

SEQ ID NO: 12911 - DNA, 13 bp, Artificial Sequence
  synthetic sequence
accaagtgcctgt

SEQ ID NO: 12912 - DNA, 13 bp, Artificial Sequence
  synthetic sequence
actactgagcctg

SEQ ID NO: 12913 - DNA, 13 bp, Artificial Sequence
  synthetic sequence
atgttccccatag

SEQ ID NO: 12914 - DNA, 13 bp, Artificial Sequence
  synthetic sequence
cccatcctgttca

SEQ ID NO: 12915 - DNA, 13 bp, Artificial Sequence
  synthetic sequence
accttctctgcca

SEQ ID NO: 12916 - DNA, 13 bp, Artificial Sequence
  synthetic sequence
actccttggagag

SEQ ID NO: 12917 - DNA, 13 bp, Artificial Sequence
  synthetic sequence
ctctcatcttgac

SEQ ID NO: 12918 - DNA, 13 bp, Artificial Sequence
  synthetic sequence
ctgttgtctttga

SEQ ID NO: 12919 - DNA, 13 bp, Artificial Sequence
  synthetic sequence
acaaatttccctg

SEQ ID NO: 12920 - DNA, 13 bp, Artificial Sequence
  synthetic sequence
cttttgcagggtc

SEQ ID NO: 12921 - DNA, 13 bp, Artificial Sequence
  synthetic sequence
gcaacagtctcat

SEQ ID NO: 12922 - DNA, 13 bp, Artificial Sequence
  synthetic sequence
ctgggcttgtcct

SEQ ID NO: 12923 - DNA, 13 bp, Artificial Sequence
  synthetic sequence
caggagacccaaa

SEQ ID NO: 12924 - DNA, 13 bp, Artificial Sequence
  synthetic sequence
agtagagctccca

SEQ ID NO: 12925 - DNA, 13 bp, Artificial Sequence
  synthetic sequence
gctcttgagttgt

SEQ ID NO: 12926 - DNA, 13 bp, Artificial Sequence
  synthetic sequence
cagcccctatgtc

SEQ ID NO: 12927 - DNA, 13 bp, Artificial Sequence
  synthetic sequence
ccatgctgattct

SEQ ID NO: 12928 - DNA, 13 bp, Artificial Sequence
  synthetic sequence
gtttgcttgttgc

SEQ ID NO: 12929 - DNA, 13 bp, Artificial Sequence
  synthetic sequence
ctgactctgatat

SEQ ID NO: 12930 - DNA, 13 bp, Artificial Sequence
  synthetic sequence
ttggtcggcttga

SEQ ID NO: 12931 - DNA, 13 bp, Artificial Sequence
  synthetic sequence
tggtctagaatgg

SEQ ID NO: 12932 - DNA, 13 bp, Artificial Sequence
  synthetic sequence
ttgaatccactca

SEQ ID NO: 12933 - DNA, 13 bp, Artificial Sequence
  synthetic sequence
ggtatcacaagag

SEQ ID NO: 12934 - DNA, 13 bp, Artificial Sequence
  synthetic sequence
caacaaagaacct

SEQ ID NO: 12935 - DNA, 13 bp, Artificial Sequence
  synthetic sequence
aagctcttctcag

SEQ ID NO: 12936 - DNA, 13 bp, Artificial Sequence
  synthetic sequence
tgaaaattcaacc

SEQ ID NO: 12937 - DNA, 13 bp, Artificial Sequence
  synthetic sequence
tctaccctcccct

SEQ ID NO: 12938 - DNA, 13 bp, Artificial Sequence
  synthetic sequence
taaagcgaaagca

SEQ ID NO: 12939 - DNA, 13 bp, Artificial Sequence
  synthetic sequence
caacatccaagaa

SEQ ID NO: 12940 - DNA, 13 bp, Artificial Sequence
  synthetic sequence
atttgcaggaata

SEQ ID NO: 12941 - DNA, 13 bp, Artificial Sequence
  synthetic sequence
gcctgactgatct

SEQ ID NO: 12942 - DNA, 13 bp, Artificial Sequence
  synthetic sequence
ccccactgatgct

SEQ ID NO: 12943 - DNA, 13 bp, Artificial Sequence
  synthetic sequence
ccagcatctcgat

SEQ ID NO: 12944 - DNA, 13 bp, Artificial Sequence
  synthetic sequence
ttctgcttccatt

SEQ ID NO: 12945 - DNA, 13 bp, Artificial Sequence
  synthetic sequence
ttctgaattaggg

SEQ ID NO: 12946 - DNA, 13 bp, Artificial Sequence
  synthetic sequence
tcagagccttcta

SEQ ID NO: 12947 - DNA, 13 bp, Artificial Sequence
  synthetic sequence
ggggcacctagga

SEQ ID NO: 12948 - DNA, 13 bp, Artificial Sequence
  synthetic sequence
gggattaggctga

SEQ ID NO: 12949 - DNA, 13 bp, Artificial Sequence
  synthetic sequence
cctcaggaatttg

SEQ ID NO: 12950 - DNA, 13 bp, Artificial Sequence
  synthetic sequence
catccaatctggt

SEQ ID NO: 12951 - DNA, 13 bp, Artificial Sequence
  synthetic sequence
aggcctctatgat

SEQ ID NO: 12952 - DNA, 13 bp, Artificial Sequence
  synthetic sequence
agaacttgacaga

SEQ ID NO: 12953 - DNA, 13 bp, Artificial Sequence
  synthetic sequence
ctcaagtctttcc

SEQ ID NO: 12954 - DNA, 13 bp, Artificial Sequence
  synthetic sequence
ctctatatgcaga

SEQ ID NO: 12955 - DNA, 13 bp, Artificial Sequence
  synthetic sequence
acccacccctact

SEQ ID NO: 12956 - DNA, 13 bp, Artificial Sequence
  synthetic sequence
gcttgataatgac

SEQ ID NO: 12957 - DNA, 13 bp, Artificial Sequence
  synthetic sequence
ctctctgaggcca

SEQ ID NO: 12958 - DNA, 13 bp, Artificial Sequence
  synthetic sequence
aatctcctatgtc

SEQ ID NO: 12959 - DNA, 13 bp, Artificial Sequence
  synthetic sequence
gtctctcggcctg

SEQ ID NO: 12960 - DNA, 13 bp, Artificial Sequence
  synthetic sequence
gcgtgagagaagg

SEQ ID NO: 12961 - DNA, 13 bp, Artificial Sequence
  synthetic sequence
aacccagttgtga

SEQ ID NO: 12962 - DNA, 13 bp, Artificial Sequence
  synthetic sequence
agtctttggaaaa

SEQ ID NO: 12963 - DNA, 13 bp, Artificial Sequence
  synthetic sequence
atgtcctcctcca

SEQ ID NO: 12964 - DNA, 13 bp, Artificial Sequence
  synthetic sequence
gaccactgaacca

SEQ ID NO: 12965 - DNA, 13 bp, Artificial Sequence
  synthetic sequence
ccctcgattcaat

SEQ ID NO: 12966 - DNA, 13 bp, Artificial Sequence
  synthetic sequence
ggatgcttgaact

SEQ ID NO: 12967 - DNA, 13 bp, Artificial Sequence
  synthetic sequence
ccaatgtcttcaa

SEQ ID NO: 12968 - DNA, 13 bp, Artificial Sequence
  synthetic sequence
tgatggaattctt

SEQ ID NO: 12969 - DNA, 13 bp, Artificial Sequence
  synthetic sequence
gaaactcagggct

SEQ ID NO: 12970 - DNA, 13 bp, Artificial Sequence
  synthetic sequence
actaatgctttcc

SEQ ID NO: 12971 - DNA, 13 bp, Artificial Sequence
  synthetic sequence
tccctaacaacaa

SEQ ID NO: 12972 - DNA, 13 bp, Artificial Sequence
  synthetic sequence
acgtgaagtcatg

SEQ ID NO: 12973 - DNA, 13 bp, Artificial Sequence
  synthetic sequence
ttccctaatcctg

SEQ ID NO: 12974 - DNA, 13 bp, Artificial Sequence
  synthetic sequence
gcctgatctcctc

SEQ ID NO: 12975 - DNA, 13 bp, Artificial Sequence
  synthetic sequence
aaccccacatgat

SEQ ID NO: 12976 - DNA, 13 bp, Artificial Sequence
  synthetic sequence
ggctgtcacaaag

SEQ ID NO: 12977 - DNA, 13 bp, Artificial Sequence
  synthetic sequence
agttatactcgac

SEQ ID NO: 12978 - DNA, 13 bp, Artificial Sequence
  synthetic sequence
cccagtcttcagg

SEQ ID NO: 12979 - DNA, 13 bp, Artificial Sequence
  synthetic sequence
catcaatggtgtc

SEQ ID NO: 12980 - DNA, 13 bp, Artificial Sequence
  synthetic sequence
tcaatgtaccaca

SEQ ID NO: 12981 - DNA, 13 bp, Artificial Sequence
  synthetic sequence
aatatgaggaatg

SEQ ID NO: 12982 - DNA, 13 bp, Artificial Sequence
  synthetic sequence
gggatgtaagcat

SEQ ID NO: 12983 - DNA, 13 bp, Artificial Sequence
  synthetic sequence
gggcacttgaact

SEQ ID NO: 12984 - DNA, 13 bp, Artificial Sequence
  synthetic sequence
gcaatgtcaagtt

SEQ ID NO: 12985 - DNA, 13 bp, Artificial Sequence
  synthetic sequence
aaaggaccatccc

SEQ ID NO: 12986 - DNA, 13 bp, Artificial Sequence
  synthetic sequence
agctctgtagtcc

SEQ ID NO: 12987 - DNA, 13 bp, Artificial Sequence
  synthetic sequence
gtttccctagcat

SEQ ID NO: 12988 - DNA, 13 bp, Artificial Sequence
  synthetic sequence
aaatgttccccat

SEQ ID NO: 12989 - DNA, 13 bp, Artificial Sequence
  synthetic sequence
ccacacacctttt

SEQ ID NO: 12990 - DNA, 13 bp, Artificial Sequence
  synthetic sequence
gcctgagtcggtc

SEQ ID NO: 12991 - DNA, 13 bp, Artificial Sequence
  synthetic sequence
tgttccagcatct

SEQ ID NO: 12992 - DNA, 13 bp, Artificial Sequence
  synthetic sequence
caccaggtgaatg

SEQ ID NO: 12993 - DNA, 13 bp, Artificial Sequence
  synthetic sequence
ggcagcttggtcc

SEQ ID NO: 12994 - DNA, 13 bp, Artificial Sequence
  synthetic sequence
gcagaccataaga

SEQ ID NO: 12995 - DNA, 13 bp, Artificial Sequence
  synthetic sequence
ctgagcaatttct

SEQ ID NO: 12996 - DNA, 13 bp, Artificial Sequence
  synthetic sequence
aatctaaatcctg

SEQ ID NO: 12997 - DNA, 13 bp, Artificial Sequence
  synthetic sequence
atgtttgtttgtt

SEQ ID NO: 12998 - DNA, 13 bp, Artificial Sequence
  synthetic sequence
catgatatcaaca

SEQ ID NO: 12999 - DNA, 13 bp, Artificial Sequence
  synthetic sequence
gccttttccaaca

SEQ ID NO: 13000 - DNA, 13 bp, Artificial Sequence
  synthetic sequence
aatatcaagttct

SEQ ID NO: 13001 - DNA, 13 bp, Artificial Sequence
  synthetic sequence
cttctttctccga

SEQ ID NO: 13002 - DNA, 13 bp, Artificial Sequence
  synthetic sequence
tctgtatatatgg

SEQ ID NO: 13003 - DNA, 13 bp, Artificial Sequence
  synthetic sequence
acctcattgtccc

SEQ ID NO: 13004 - DNA, 13 bp, Artificial Sequence
  synthetic sequence
agaaagagcggtg

SEQ ID NO: 13005 - DNA, 13 bp, Artificial Sequence
  synthetic sequence
ggatgattcatct

SEQ ID NO: 13006 - DNA, 13 bp, Artificial Sequence
  synthetic sequence
cgtacaattgctt

SEQ ID NO: 13007 - DNA, 13 bp, Artificial Sequence
  synthetic sequence
cagggtatataat

SEQ ID NO: 13008 - DNA, 13 bp, Artificial Sequence
  synthetic sequence
gagaccaaactcg

SEQ ID NO: 13009 - DNA, 13 bp, Artificial Sequence
  synthetic sequence
gcagatattgcta

SEQ ID NO: 13010 - DNA, 13 bp, Artificial Sequence
  synthetic sequence
ctttaagtggggc

SEQ ID NO: 13011 - DNA, 13 bp, Artificial Sequence
  synthetic sequence
tttattaatcaaa

SEQ ID NO: 13012 - DNA, 13 bp, Artificial Sequence
  synthetic sequence
atgaccatttgaa

SEQ ID NO: 13013 - DNA, 13 bp, Artificial Sequence
  synthetic sequence
agagctgggtgca

SEQ ID NO: 13014 - DNA, 13 bp, Artificial Sequence
  synthetic sequence
aatagagcctatt

SEQ ID NO: 13015 - DNA, 13 bp, Artificial Sequence
  synthetic sequence
cacttccaccttg

SEQ ID NO: 13016 - DNA, 13 bp, Artificial Sequence
  synthetic sequence
taactgattgatc

SEQ ID NO: 13017 - DNA, 13 bp, Artificial Sequence
  synthetic sequence
aagacgtactcag

SEQ ID NO: 13018 - DNA, 13 bp, Artificial Sequence
  synthetic sequence
accgattattctt

SEQ ID NO: 13019 - DNA, 13 bp, Artificial Sequence
  synthetic sequence
atgccgcattagc

SEQ ID NO: 13020 - DNA, 13 bp, Artificial Sequence
  synthetic sequence
agtcatcattgag

SEQ ID NO: 13021 - DNA, 13 bp, Artificial Sequence
  synthetic sequence
ggctttagttttt

SEQ ID NO: 13022 - DNA, 13 bp, Artificial Sequence
  synthetic sequence
agttttgccctac

SEQ ID NO: 13023 - DNA, 13 bp, Artificial Sequence
  synthetic sequence
gctattctccagg

SEQ ID NO: 13024 - DNA, 13 bp, Artificial Sequence
  synthetic sequence
agtcatatgtatg

SEQ ID NO: 13025 - DNA, 13 bp, Artificial Sequence
  synthetic sequence
acttccatcttgg

SEQ ID NO: 13026 - DNA, 13 bp, Artificial Sequence
  synthetic sequence
tcattaatcaggg

SEQ ID NO: 13027 - DNA, 13 bp, Artificial Sequence
  synthetic sequence
atctgcattttat

SEQ ID NO: 13028 - DNA, 13 bp, Artificial Sequence
  synthetic sequence
aagaaccacttaa

SEQ ID NO: 13029 - DNA, 13 bp, Artificial Sequence
  synthetic sequence
tagtagactcctt

SEQ ID NO: 13030 - DNA, 13 bp, Artificial Sequence
  synthetic sequence
aacaaaagcacat

SEQ ID NO: 13031 - DNA, 13 bp, Artificial Sequence
  synthetic sequence
caacaactcgtga

SEQ ID NO: 13032 - DNA, 13 bp, Artificial Sequence
  synthetic sequence
gctgatcttattg

SEQ ID NO: 13033 - DNA, 13 bp, Artificial Sequence
  synthetic sequence
ctaaaggaaaagt

SEQ ID NO: 13034 - DNA, 13 bp, Artificial Sequence
  synthetic sequence
gatgaccatttga

SEQ ID NO: 13035 - DNA, 13 bp, Artificial Sequence
  synthetic sequence
ggtcagactgctg

SEQ ID NO: 13036 - DNA, 13 bp, Artificial Sequence
  synthetic sequence
caaacagctgatt

SEQ ID NO: 13037 - DNA, 13 bp, Artificial Sequence
  synthetic sequence
caatctacctcat

SEQ ID NO: 13038 - DNA, 13 bp, Artificial Sequence
  synthetic sequence
aatttcgttccgt

SEQ ID NO: 13039 - DNA, 13 bp, Artificial Sequence
  synthetic sequence
ccgttcaaactgg

SEQ ID NO: 13040 - DNA, 13 bp, Artificial Sequence
  synthetic sequence
tatcatctcttta

SEQ ID NO: 13041 - DNA, 13 bp, Artificial Sequence
  synthetic sequence
atatggggtttat

SEQ ID NO: 13042 - DNA, 13 bp, Artificial Sequence
  synthetic sequence
aagtcttgttagg

SEQ ID NO: 13043 - DNA, 13 bp, Artificial Sequence
  synthetic sequence
taaatgtagttaa

SEQ ID NO: 13044 - DNA, 13 bp, Artificial Sequence
  synthetic sequence
atatgatttatta

SEQ ID NO: 13045 - DNA, 13 bp, Artificial Sequence
  synthetic sequence
tgtcatttagtat

SEQ ID NO: 13046 - DNA, 13 bp, Artificial Sequence
  synthetic sequence
tttacttataatg

SEQ ID NO: 13047 - DNA, 13 bp, Artificial Sequence
  synthetic sequence
atacagatgtctt

SEQ ID NO: 13048 - DNA, 13 bp, Artificial Sequence
  synthetic sequence
caatccctgttgg

SEQ ID NO: 13049 - DNA, 13 bp, Artificial Sequence
  synthetic sequence
ccaatatagggat

SEQ ID NO: 13050 - DNA, 13 bp, Artificial Sequence
  synthetic sequence
tgttaacatcatc

SEQ ID NO: 13051 - DNA, 13 bp, Artificial Sequence
  synthetic sequence
atgcaaagaccca

SEQ ID NO: 13052 - DNA, 13 bp, Artificial Sequence
  synthetic sequence
ttaacggaacgaa

SEQ ID NO: 13053 - DNA, 13 bp, Artificial Sequence
  synthetic sequence
taccctggttata

SEQ ID NO: 13054 - DNA, 13 bp, Artificial Sequence
  synthetic sequence
tgacaggactgat

SEQ ID NO: 13055 - DNA, 13 bp, Artificial Sequence
  synthetic sequence
tcatgtataagat

SEQ ID NO: 13056 - DNA, 13 bp, Artificial Sequence
  synthetic sequence
gtttgacggcccc

SEQ ID NO: 13057 - DNA, 13 bp, Artificial Sequence
  synthetic sequence
tgccattatggtg

SEQ ID NO: 13058 - DNA, 13 bp, Artificial Sequence
  synthetic sequence
tttgactcatcaa

SEQ ID NO: 13059 - DNA, 13 bp, Artificial Sequence
  synthetic sequence
ggctcttctaagt

SEQ ID NO: 13060 - DNA, 13 bp, Artificial Sequence
  synthetic sequence
tattaattgactt

SEQ ID NO: 13061 - DNA, 13 bp, Artificial Sequence
  synthetic sequence
ggataaaacaaat

SEQ ID NO: 13062 - DNA, 13 bp, Artificial Sequence
  synthetic sequence
acgagagtctgag

SEQ ID NO: 13063 - DNA, 13 bp, Artificial Sequence
  synthetic sequence
cagccaggaagtc

SEQ ID NO: 13064 - DNA, 13 bp, Artificial Sequence
  synthetic sequence
tctttttgttcag

SEQ ID NO: 13065 - DNA, 13 bp, Artificial Sequence
  synthetic sequence
atatctacaaggg

SEQ ID NO: 13066 - DNA, 13 bp, Artificial Sequence
  synthetic sequence
taacatgtacaag

SEQ ID NO: 13067 - DNA, 13 bp, Artificial Sequence
  synthetic sequence
tggtggataacat

SEQ ID NO: 13068 - DNA, 13 bp, Artificial Sequence
  synthetic sequence
gtttggtctccaa

SEQ ID NO: 13069 - DNA, 13 bp, Artificial Sequence
  synthetic sequence
gttgtcttgcact

SEQ ID NO: 13070 - DNA, 13 bp, Artificial Sequence
  synthetic sequence
aatccctgttgga

SEQ ID NO: 13071 - DNA, 13 bp, Artificial Sequence
  synthetic sequence
ccaccgctctttc

SEQ ID NO: 13072 - DNA, 13 bp, Artificial Sequence
  synthetic sequence
taagtcaatggaa

SEQ ID NO: 13073 - DNA, 13 bp, Artificial Sequence
  synthetic sequence
ttaagaattatcg

SEQ ID NO: 13074 - DNA, 13 bp, Artificial Sequence
  synthetic sequence
agtcgatagaatt

SEQ ID NO: 13075 - DNA, 13 bp, Artificial Sequence
  synthetic sequence
taatcggtaatgc

SEQ ID NO: 13076 - DNA, 13 bp, Artificial Sequence
  synthetic sequence
acttataatgagg

SEQ ID NO: 13077 - DNA, 13 bp, Artificial Sequence
  synthetic sequence
tccaatataggga

SEQ ID NO: 13078 - DNA, 13 bp, Artificial Sequence
  synthetic sequence
acatatgacttaa

SEQ ID NO: 13079 - DNA, 13 bp, Artificial Sequence
  synthetic sequence
gactatataatga

SEQ ID NO: 13080 - DNA, 13 bp, Artificial Sequence
  synthetic sequence
attaattgactta

SEQ ID NO: 13081 - DNA, 13 bp, Artificial Sequence
  synthetic sequence
ttgtaatgaagaa

SEQ ID NO: 13082 - DNA, 13 bp, Artificial Sequence
  synthetic sequence
gaaaatcagttag

SEQ ID NO: 13083 - DNA, 13 bp, Artificial Sequence
  synthetic sequence
acagataacaata

SEQ ID NO: 13084 - DNA, 13 bp, Artificial Sequence
  synthetic sequence
aacaaatctatac

SEQ ID NO: 13085 - DNA, 13 bp, Artificial Sequence
  synthetic sequence
ggcggagatcaaa

SEQ ID NO: 13086 - DNA, 13 bp, Artificial Sequence
  synthetic sequence
ctaccagaaagaa

SEQ ID NO: 13087 - DNA, 13 bp, Artificial Sequence
  synthetic sequence
actgttaaatatt

SEQ ID NO: 13088 - DNA, 13 bp, Artificial Sequence
  synthetic sequence
caagtcgggcata

SEQ ID NO: 13089 - DNA, 13 bp, Artificial Sequence
  synthetic sequence
ttacaggaaattc

SEQ ID NO: 13090 - DNA, 13 bp, Artificial Sequence
  synthetic sequence
aatatactccaca

SEQ ID NO: 13091 - DNA, 13 bp, Artificial Sequence
  synthetic sequence
ctagcagataagc

SEQ ID NO: 13092 - DNA, 13 bp, Artificial Sequence
  synthetic sequence
agtttctatgtag

SEQ ID NO: 13093 - DNA, 13 bp, Artificial Sequence
  synthetic sequence
tcatactgctcag

SEQ ID NO: 13094 - DNA, 13 bp, Artificial Sequence
  synthetic sequence
ataccccactaag

SEQ ID NO: 13095 - DNA, 13 bp, Artificial Sequence
  synthetic sequence
aacagtattgttg

SEQ ID NO: 13096 - DNA, 13 bp, Artificial Sequence
  synthetic sequence
gaagcattaaaca

SEQ ID NO: 13097 - DNA, 13 bp, Artificial Sequence
  synthetic sequence
tggctaggcctgc

SEQ ID NO: 13098 - DNA, 13 bp, Artificial Sequence
  synthetic sequence
cctaattttgctg

SEQ ID NO: 13099 - DNA, 13 bp, Artificial Sequence
  synthetic sequence
attaaaaagactt

SEQ ID NO: 13100 - DNA, 13 bp, Artificial Sequence
  synthetic sequence
gtcctgatcctac

SEQ ID NO: 13101 - DNA, 13 bp, Artificial Sequence
  synthetic sequence
actgttgttattt

SEQ ID NO: 13102 - DNA, 13 bp, Artificial Sequence
  synthetic sequence
caaattttactac

SEQ ID NO: 13103 - DNA, 13 bp, Artificial Sequence
  synthetic sequence
ctattgttagaca

SEQ ID NO: 13104 - DNA, 13 bp, Artificial Sequence
  synthetic sequence
atctatgaaacca

SEQ ID NO: 13105 - DNA, 13 bp, Artificial Sequence
  synthetic sequence
gacgctgtcaaca

SEQ ID NO: 13106 - DNA, 13 bp, Artificial Sequence
  synthetic sequence
caaaaaccttttg

SEQ ID NO: 13107 - DNA, 13 bp, Artificial Sequence
  synthetic sequence
tccagatgtatat

SEQ ID NO: 13108 - DNA, 13 bp, Artificial Sequence
  synthetic sequence
caatgcacaaagc

SEQ ID NO: 13109 - DNA, 13 bp, Artificial Sequence
  synthetic sequence
gcagcattcactt

SEQ ID NO: 13110 - DNA, 13 bp, Artificial Sequence
  synthetic sequence
caagagaaaatct

SEQ ID NO: 13111 - DNA, 13 bp, Artificial Sequence
  synthetic sequence
agcaggatatgta

SEQ ID NO: 13112 - DNA, 13 bp, Artificial Sequence
  synthetic sequence
tatataaaaggat

SEQ ID NO: 13113 - DNA, 13 bp, Artificial Sequence
  synthetic sequence
gagaatggtatta

SEQ ID NO: 13114 - DNA, 13 bp, Artificial Sequence
  synthetic sequence
agtggaagcagaa

SEQ ID NO: 13115 - DNA, 13 bp, Artificial Sequence
  synthetic sequence
tgtatgttgatga

SEQ ID NO: 13116 - DNA, 13 bp, Artificial Sequence
  synthetic sequence
gtaaggtggaaag

SEQ ID NO: 13117 - DNA, 13 bp, Artificial Sequence
  synthetic sequence
gtcagacagacaa

SEQ ID NO: 13118 - DNA, 13 bp, Artificial Sequence
  synthetic sequence
gtatacaaattgt

SEQ ID NO: 13119 - DNA, 13 bp, Artificial Sequence
  synthetic sequence
gtcattggtggtg

SEQ ID NO: 13120 - DNA, 13 bp, Artificial Sequence
  synthetic sequence
tttttaaaagagt

SEQ ID NO: 13121 - DNA, 13 bp, Artificial Sequence
  synthetic sequence
tttttggtattac

SEQ ID NO: 13122 - DNA, 13 bp, Artificial Sequence
  synthetic sequence
taatgaaattgga

SEQ ID NO: 13123 - DNA, 13 bp, Artificial Sequence
  synthetic sequence
gtttttaattgtt

SEQ ID NO: 13124 - DNA, 13 bp, Artificial Sequence
  synthetic sequence
atgtatacctctt

SEQ ID NO: 13125 - DNA, 13 bp, Artificial Sequence
  synthetic sequence
tatgccaacgagg

SEQ ID NO: 13126 - DNA, 13 bp, Artificial Sequence
  synthetic sequence
atatatttgcctt

SEQ ID NO: 13127 - DNA, 13 bp, Artificial Sequence
  synthetic sequence
attgcaatactag

SEQ ID NO: 13128 - DNA, 13 bp, Artificial Sequence
  synthetic sequence
tatttttaaagct

SEQ ID NO: 13129 - DNA, 13 bp, Artificial Sequence
  synthetic sequence
accaaataagagt

SEQ ID NO: 13130 - DNA, 13 bp, Artificial Sequence
  synthetic sequence
attgctttaagtc

SEQ ID NO: 13131 - DNA, 13 bp, Artificial Sequence
  synthetic sequence
ttaccagtctctg

SEQ ID NO: 13132 - DNA, 13 bp, Artificial Sequence
  synthetic sequence
taatatttcttgt

SEQ ID NO: 13133 - DNA, 13 bp, Artificial Sequence
  synthetic sequence
acaaacccattag

SEQ ID NO: 13134 - DNA, 13 bp, Artificial Sequence
  synthetic sequence
ttaactttaaagg

SEQ ID NO: 13135 - DNA, 13 bp, Artificial Sequence
  synthetic sequence
tctgctttggaaa

SEQ ID NO: 13136 - DNA, 13 bp, Artificial Sequence
  synthetic sequence
cttgtttcaataa

SEQ ID NO: 13137 - DNA, 13 bp, Artificial Sequence
  synthetic sequence
tgaagtggttgct

SEQ ID NO: 13138 - DNA, 13 bp, Artificial Sequence
  synthetic sequence
tttactttgccat

SEQ ID NO: 13139 - DNA, 13 bp, Artificial Sequence
  synthetic sequence
gaggggtggatgg

SEQ ID NO: 13140 - DNA, 13 bp, Artificial Sequence
  synthetic sequence
ccctgtgaaggtg

SEQ ID NO: 13141 - DNA, 13 bp, Artificial Sequence
  synthetic sequence
gaatagttttatt

SEQ ID NO: 13142 - DNA, 13 bp, Artificial Sequence
  synthetic sequence
tgtgggtcttcct

SEQ ID NO: 13143 - DNA, 13 bp, Artificial Sequence
  synthetic sequence
tcagtatgaatac

SEQ ID NO: 13144 - DNA, 13 bp, Artificial Sequence
  synthetic sequence
aggtttgtatgtg

SEQ ID NO: 13145 - DNA, 13 bp, Artificial Sequence
  synthetic sequence
agattctggtgta

SEQ ID NO: 13146 - DNA, 13 bp, Artificial Sequence
  synthetic sequence
tggaagcatttgt

SEQ ID NO: 13147 - DNA, 13 bp, Artificial Sequence
  synthetic sequence
taaatcctaaaaa

SEQ ID NO: 13148 - DNA, 13 bp, Artificial Sequence
  synthetic sequence
ttaggatcatcat

SEQ ID NO: 13149 - DNA, 13 bp, Artificial Sequence
  synthetic sequence
ttgagaaggatgt

SEQ ID NO: 13150 - DNA, 13 bp, Artificial Sequence
  synthetic sequence
ttgagggcgagga

SEQ ID NO: 13151 - DNA, 13 bp, Artificial Sequence
  synthetic sequence
ctggactatttaa

SEQ ID NO: 13152 - DNA, 13 bp, Artificial Sequence
  synthetic sequence
ccttttggaaaaa

SEQ ID NO: 13153 - DNA, 13 bp, Artificial Sequence
  synthetic sequence
tctgtgacattgg

SEQ ID NO: 13154 - DNA, 13 bp, Artificial Sequence
  synthetic sequence
tgtggattgaaga

SEQ ID NO: 13155 - DNA, 13 bp, Artificial Sequence
  synthetic sequence
cagcggagaacag

SEQ ID NO: 13156 - DNA, 13 bp, Artificial Sequence
  synthetic sequence
agaagaaaatggg

SEQ ID NO: 13157 - DNA, 13 bp, Artificial Sequence
  synthetic sequence
tgagaccagggcc

SEQ ID NO: 13158 - DNA, 13 bp, Artificial Sequence
  synthetic sequence
gaggagggtggag

SEQ ID NO: 13159 - DNA, 13 bp, Artificial Sequence
  synthetic sequence
tttggtcaacaaa

SEQ ID NO: 13160 - DNA, 13 bp, Artificial Sequence
  synthetic sequence
aataccaacaaac

SEQ ID NO: 13161 - DNA, 13 bp, Artificial Sequence
  synthetic sequence
tgtactgggttag

SEQ ID NO: 13162 - DNA, 13 bp, Artificial Sequence
  synthetic sequence
ataagatgcatgg

SEQ ID NO: 13163 - DNA, 13 bp, Artificial Sequence
  synthetic sequence
tacaacatgatgg

SEQ ID NO: 13164 - DNA, 13 bp, Artificial Sequence
  synthetic sequence
gactggctgtggg

SEQ ID NO: 13165 - DNA, 13 bp, Artificial Sequence
  synthetic sequence
gctatggatggaa

SEQ ID NO: 13166 - DNA, 13 bp, Artificial Sequence
  synthetic sequence
gctcgatggtgaa

SEQ ID NO: 13167 - DNA, 13 bp, Artificial Sequence
  synthetic sequence
taggaaagagaga

SEQ ID NO: 13168 - DNA, 13 bp, Artificial Sequence
  synthetic sequence
aagaaatctccca

SEQ ID NO: 13169 - DNA, 13 bp, Artificial Sequence
  synthetic sequence
tctggaagtcaag

SEQ ID NO: 13170 - DNA, 13 bp, Artificial Sequence
  synthetic sequence
ctacaagaatgtg

SEQ ID NO: 13171 - DNA, 13 bp, Artificial Sequence
  synthetic sequence
ggaagaatggacc

SEQ ID NO: 13172 - DNA, 13 bp, Artificial Sequence
  synthetic sequence
tgggcactgtatg

SEQ ID NO: 13173 - DNA, 13 bp, Artificial Sequence
  synthetic sequence
ccagtcaactggg

SEQ ID NO: 13174 - DNA, 13 bp, Artificial Sequence
  synthetic sequence
gagcaggatggaa

SEQ ID NO: 13175 - DNA, 13 bp, Artificial Sequence
  synthetic sequence
caaatgaccctgc

SEQ ID NO: 13176 - DNA, 13 bp, Artificial Sequence
  synthetic sequence
cagcccttgtgac

SEQ ID NO: 13177 - DNA, 13 bp, Artificial Sequence
  synthetic sequence
acttcaatgaact

SEQ ID NO: 13178 - DNA, 13 bp, Artificial Sequence
  synthetic sequence
aggagagaagggc

SEQ ID NO: 13179 - DNA, 13 bp, Artificial Sequence
  synthetic sequence
tgggagccatgtt

SEQ ID NO: 13180 - DNA, 13 bp, Artificial Sequence
  synthetic sequence
aggaagatgtgaa

SEQ ID NO: 13181 - DNA, 13 bp, Artificial Sequence
  synthetic sequence
ttttcactaacag

SEQ ID NO: 13182 - DNA, 13 bp, Artificial Sequence
  synthetic sequence
ctgagttctgcat

SEQ ID NO: 13183 - DNA, 13 bp, Artificial Sequence
  synthetic sequence
acagatttgccac

SEQ ID NO: 13184 - DNA, 13 bp, Artificial Sequence
  synthetic sequence
ggtacatgtggct

SEQ ID NO: 13185 - DNA, 13 bp, Artificial Sequence
  synthetic sequence
acatgtggttggg

SEQ ID NO: 13186 - DNA, 13 bp, Artificial Sequence
  synthetic sequence
acatgtcaaaaat

SEQ ID NO: 13187 - DNA, 13 bp, Artificial Sequence
  synthetic sequence
acattgccaaatt

SEQ ID NO: 13188 - DNA, 13 bp, Artificial Sequence
  synthetic sequence
tcacaggtggcca

SEQ ID NO: 13189 - DNA, 13 bp, Artificial Sequence
  synthetic sequence
gagtgggccacga

SEQ ID NO: 13190 - DNA, 13 bp, Artificial Sequence
  synthetic sequence
gtttgaagaacag

SEQ ID NO: 13191 - DNA, 13 bp, Artificial Sequence
  synthetic sequence
taatgctgaagga

SEQ ID NO: 13192 - DNA, 13 bp, Artificial Sequence
  synthetic sequence
tggggtcagcagc

SEQ ID NO: 13193 - DNA, 13 bp, Artificial Sequence
  synthetic sequence
catacacgcccaa

SEQ ID NO: 13194 - DNA, 13 bp, Artificial Sequence
  synthetic sequence
acatgcccaaaat

SEQ ID NO: 13195 - DNA, 13 bp, Artificial Sequence
  synthetic sequence
aacagccatcgca

SEQ ID NO: 13196 - DNA, 13 bp, Artificial Sequence
  synthetic sequence
tagggtgttggaa

SEQ ID NO: 13197 - DNA, 13 bp, Artificial Sequence
  synthetic sequence
ctggagagaacca

SEQ ID NO: 13198 - DNA, 13 bp, Artificial Sequence
  synthetic sequence
gtgaaagagacag

SEQ ID NO: 13199 - DNA, 13 bp, Artificial Sequence
  synthetic sequence
tcagaatgatggc

SEQ ID NO: 13200 - DNA, 13 bp, Artificial Sequence
  synthetic sequence
gacagtctacaag

SEQ ID NO: 13201 - DNA, 13 bp, Artificial Sequence
  synthetic sequence
cgacacatgagat

SEQ ID NO: 13202 - DNA, 13 bp, Artificial Sequence
  synthetic sequence
tggtgaatggagt

SEQ ID NO: 13203 - DNA, 13 bp, Artificial Sequence
  synthetic sequence
caatatgatggga

SEQ ID NO: 13204 - DNA, 13 bp, Artificial Sequence
  synthetic sequence
tggccaaagcggt

SEQ ID NO: 13205 - DNA, 13 bp, Artificial Sequence
  synthetic sequence
gttgtgggacttt

SEQ ID NO: 13206 - DNA, 13 bp, Artificial Sequence
  synthetic sequence
atgcagagctacg

SEQ ID NO: 13207 - DNA, 13 bp, Artificial Sequence
  synthetic sequence
tcaaaccagccac

SEQ ID NO: 13208 - DNA, 13 bp, Artificial Sequence
  synthetic sequence
gagaagacatatg

SEQ ID NO: 13209 - DNA, 13 bp, Artificial Sequence
  synthetic sequence
tatgaggaggacg

SEQ ID NO: 13210 - DNA, 13 bp, Artificial Sequence
  synthetic sequence
gacgggaagacct

SEQ ID NO: 13211 - DNA, 13 bp, Artificial Sequence
  synthetic sequence
ctgctggaatcat

SEQ ID NO: 13212 - DNA, 13 bp, Artificial Sequence
  synthetic sequence
cactccttttggg

SEQ ID NO: 13213 - DNA, 13 bp, Artificial Sequence
  synthetic sequence
ccaagtccgacat

SEQ ID NO: 13214 - DNA, 13 bp, Artificial Sequence
  synthetic sequence
agccggtgtgttg

SEQ ID NO: 13215 - DNA, 13 bp, Artificial Sequence
  synthetic sequence
atgtcaataacct

SEQ ID NO: 13216 - DNA, 13 bp, Artificial Sequence
  synthetic sequence
acgccaatgacag

SEQ ID NO: 13217 - DNA, 13 bp, Artificial Sequence
  synthetic sequence
aggatggagctac

SEQ ID NO: 13218 - DNA, 13 bp, Artificial Sequence
  synthetic sequence
tcagctgctcttg

SEQ ID NO: 13219 - DNA, 13 bp, Artificial Sequence
  synthetic sequence
ctctaaatacttt

SEQ ID NO: 13220 - DNA, 13 bp, Artificial Sequence
  synthetic sequence
acggctgaaagag

SEQ ID NO: 13221 - DNA, 13 bp, Artificial Sequence
  synthetic sequence
ggaaaagggctcc

SEQ ID NO: 13222 - DNA, 13 bp, Artificial Sequence
  synthetic sequence
gaattcatggcat

SEQ ID NO: 13223 - DNA, 13 bp, Artificial Sequence
  synthetic sequence
cagtggagtggtt

SEQ ID NO: 13224 - DNA, 13 bp, Artificial Sequence
  synthetic sequence
agggtggaacatc

SEQ ID NO: 13225 - DNA, 13 bp, Artificial Sequence
  synthetic sequence
tcgagctgagttc

SEQ ID NO: 13226 - DNA, 13 bp, Artificial Sequence
  synthetic sequence
acaaagagaatgg

SEQ ID NO: 13227 - DNA, 13 bp, Artificial Sequence
  synthetic sequence
ctggtgtactgct

SEQ ID NO: 13228 - DNA, 13 bp, Artificial Sequence
  synthetic sequence
tctggtgtggaag

SEQ ID NO: 13229 - DNA, 13 bp, Artificial Sequence
  synthetic sequence
ggatacatcctgc

SEQ ID NO: 13230 - DNA, 13 bp, Artificial Sequence
  synthetic sequence
tcaggatgatggc

SEQ ID NO: 13231 - DNA, 13 bp, Artificial Sequence
  synthetic sequence
aacgaggcaaaga

SEQ ID NO: 13232 - DNA, 13 bp, Artificial Sequence
  synthetic sequence
gctagggtgctgg

SEQ ID NO: 13233 - DNA, 13 bp, Artificial Sequence
  synthetic sequence
tgcggatctgcat

SEQ ID NO: 13234 - DNA, 13 bp, Artificial Sequence
  synthetic sequence
cactcactgccat

SEQ ID NO: 13235 - DNA, 13 bp, Artificial Sequence
  synthetic sequence
tcccatggttttg

SEQ ID NO: 13236 - DNA, 13 bp, Artificial Sequence
  synthetic sequence
atcctttcacttc

SEQ ID NO: 13237 - DNA, 13 bp, Artificial Sequence
  synthetic sequence
acatctttcctcc

SEQ ID NO: 13238 - DNA, 13 bp, Artificial Sequence
  synthetic sequence
gtgtcatgaccat

SEQ ID NO: 13239 - DNA, 13 bp, Artificial Sequence
  synthetic sequence
tgcagtttttcca

SEQ ID NO: 13240 - DNA, 13 bp, Artificial Sequence
  synthetic sequence
ggtcatacgtcca

SEQ ID NO: 13241 - DNA, 13 bp, Artificial Sequence
  synthetic sequence
gaaggtttccatt

SEQ ID NO: 13242 - DNA, 13 bp, Artificial Sequence
  synthetic sequence
gtatggaatgtcg

SEQ ID NO: 13243 - DNA, 13 bp, Artificial Sequence
  synthetic sequence
cctgccagcctgg

SEQ ID NO: 13244 - DNA, 13 bp, Artificial Sequence
  synthetic sequence
cacagtgtcagct

SEQ ID NO: 13245 - DNA, 13 bp, Artificial Sequence
  synthetic sequence
tcatcaaccattt

SEQ ID NO: 13246 - DNA, 13 bp, Artificial Sequence
  synthetic sequence
ggtctggcttctc

SEQ ID NO: 13247 - DNA, 13 bp, Artificial Sequence
  synthetic sequence
ttcccaaattctc

SEQ ID NO: 13248 - DNA, 13 bp, Artificial Sequence
  synthetic sequence
tcatgaggttgca

SEQ ID NO: 13249 - DNA, 13 bp, Artificial Sequence
  synthetic sequence
tttggtcttctct

SEQ ID NO: 13250 - DNA, 13 bp, Artificial Sequence
  synthetic sequence
tggctgttcacct

SEQ ID NO: 13251 - DNA, 13 bp, Artificial Sequence
  synthetic sequence
tgaattgaccatg

SEQ ID NO: 13252 - DNA, 13 bp, Artificial Sequence
  synthetic sequence
ccatgggtttgac

SEQ ID NO: 13253 - DNA, 13 bp, Artificial Sequence
  synthetic sequence
accacatctgagc

SEQ ID NO: 13254 - DNA, 13 bp, Artificial Sequence
  synthetic sequence
aatggcatcccat

SEQ ID NO: 13255 - DNA, 13 bp, Artificial Sequence
  synthetic sequence
tgtatgatgtttc

SEQ ID NO: 13256 - DNA, 13 bp, Artificial Sequence
  synthetic sequence
tggcaccacgatg

SEQ ID NO: 13257 - DNA, 13 bp, Artificial Sequence
  synthetic sequence
agagtggctcctt

SEQ ID NO: 13258 - DNA, 13 bp, Artificial Sequence
  synthetic sequence
cctctgcaagctt

SEQ ID NO: 13259 - DNA, 13 bp, Artificial Sequence
  synthetic sequence
aattctttgatcg

SEQ ID NO: 13260 - DNA, 13 bp, Artificial Sequence
  synthetic sequence
tcaactcctccat

SEQ ID NO: 13261 - DNA, 13 bp, Artificial Sequence
  synthetic sequence
ccaacactcttgc

SEQ ID NO: 13262 - DNA, 13 bp, Artificial Sequence
  synthetic sequence
atgtcatcctcat

SEQ ID NO: 13263 - DNA, 13 bp, Artificial Sequence
  synthetic sequence
ggtggttcgggag

SEQ ID NO: 13264 - DNA, 13 bp, Artificial Sequence
  synthetic sequence
ggggctctgtcta

SEQ ID NO: 13265 - DNA, 13 bp, Artificial Sequence
  synthetic sequence
tgacaggtctggt

SEQ ID NO: 13266 - DNA, 13 bp, Artificial Sequence
  synthetic sequence
ggtgataggtctg

SEQ ID NO: 13267 - DNA, 13 bp, Artificial Sequence
  synthetic sequence
gcttttgtgtcaa

SEQ ID NO: 13268 - DNA, 13 bp, Artificial Sequence
  synthetic sequence
tccgtctttcctg

SEQ ID NO: 13269 - DNA, 13 bp, Artificial Sequence
  synthetic sequence
tcgcggctcatcc

SEQ ID NO: 13270 - DNA, 13 bp, Artificial Sequence
  synthetic sequence
cactcttgctgtc

SEQ ID NO: 13271 - DNA, 13 bp, Artificial Sequence
  synthetic sequence
tcatcctcatcta

SEQ ID NO: 13272 - DNA, 13 bp, Artificial Sequence
  synthetic sequence
gaacagatccctg

SEQ ID NO: 13273 - DNA, 13 bp, Artificial Sequence
  synthetic sequence
gagtggctccctt

SEQ ID NO: 13274 - DNA, 13 bp, Artificial Sequence
  synthetic sequence
aattcttctgggg

SEQ ID NO: 13275 - DNA, 13 bp, Artificial Sequence
  synthetic sequence
gtgaccacctgtc

SEQ ID NO: 13276 - DNA, 13 bp, Artificial Sequence
  synthetic sequence
tcatccactcacc

SEQ ID NO: 13277 - DNA, 13 bp, Artificial Sequence
  synthetic sequence
cctccgcaagctt

SEQ ID NO: 13278 - DNA, 13 bp, Artificial Sequence
  synthetic sequence
catgagcaaccac

SEQ ID NO: 13279 - DNA, 13 bp, Artificial Sequence
  synthetic sequence
ccaaccgctgttg

SEQ ID NO: 13280 - DNA, 13 bp, Artificial Sequence
  synthetic sequence
cctgcatggtacc

SEQ ID NO: 13281 - DNA, 13 bp, Artificial Sequence
  synthetic sequence
tgagcacttggct

SEQ ID NO: 13282 - DNA, 13 bp, Artificial Sequence
  synthetic sequence
tgaatggcattcc

SEQ ID NO: 13283 - DNA, 13 bp, Artificial Sequence
  synthetic sequence
cccaaaactttgg

SEQ ID NO: 13284 - DNA, 13 bp, Artificial Sequence
  synthetic sequence
cgttctgtatggg

SEQ ID NO: 13285 - DNA, 13 bp, Artificial Sequence
  synthetic sequence
tccgagtctcact

SEQ ID NO: 13286 - DNA, 13 bp, Artificial Sequence
  synthetic sequence
ggcggtaggtcaa

SEQ ID NO: 13287 - DNA, 13 bp, Artificial Sequence
  synthetic sequence
gttttgtctttca

SEQ ID NO: 13288 - DNA, 13 bp, Artificial Sequence
  synthetic sequence
tcctgaatgtcct

SEQ ID NO: 13289 - DNA, 13 bp, Artificial Sequence
  synthetic sequence
ggctctgcttcct

SEQ ID NO: 13290 - DNA, 13 bp, Artificial Sequence
  synthetic sequence
ctccatacttccg

SEQ ID NO: 13291 - DNA, 13 bp, Artificial Sequence
  synthetic sequence
tgcggatctgtat

SEQ ID NO: 13292 - DNA, 13 bp, Artificial Sequence
  synthetic sequence
tcctgcatggcac

SEQ ID NO: 13293 - DNA, 13 bp, Artificial Sequence
  synthetic sequence
tttctttagccac

SEQ ID NO: 13294 - DNA, 13 bp, Artificial Sequence
  synthetic sequence
cattccattggtc

SEQ ID NO: 13295 - DNA, 13 bp, Artificial Sequence
  synthetic sequence
tcataaccattgt

SEQ ID NO: 13296 - DNA, 13 bp, Artificial Sequence
  synthetic sequence
cttgccatccagg

SEQ ID NO: 13297 - DNA, 13 bp, Artificial Sequence
  synthetic sequence
ctgtgtcgtctgc

SEQ ID NO: 13298 - DNA, 13 bp, Artificial Sequence
  synthetic sequence
ttcctggacgaac

SEQ ID NO: 13299 - DNA, 13 bp, Artificial Sequence
  synthetic sequence
cgctctatctact

SEQ ID NO: 13300 - DNA, 13 bp, Artificial Sequence
  synthetic sequence
agctttccgacgg

SEQ ID NO: 13301 - DNA, 13 bp, Artificial Sequence
  synthetic sequence
tccgcccttggtg

SEQ ID NO: 13302 - DNA, 13 bp, Artificial Sequence
  synthetic sequence
ggtggctcctttt

SEQ ID NO: 13303 - DNA, 13 bp, Artificial Sequence
  synthetic sequence
cctgtcttcttct

SEQ ID NO: 13304 - DNA, 13 bp, Artificial Sequence
  synthetic sequence
gcaggttcagatg

SEQ ID NO: 13305 - DNA, 13 bp, Artificial Sequence
  synthetic sequence
ttcagttatccac

SEQ ID NO: 13306 - DNA, 13 bp, Artificial Sequence
  synthetic sequence
tgtccgttgccac

SEQ ID NO: 13307 - DNA, 13 bp, Artificial Sequence
  synthetic sequence
tttcagtgagctt

SEQ ID NO: 13308 - DNA, 13 bp, Artificial Sequence
  synthetic sequence
cttatggaacacg

SEQ ID NO: 13309 - DNA, 13 bp, Artificial Sequence
  synthetic sequence
ctccccatgagta

SEQ ID NO: 13310 - DNA, 13 bp, Artificial Sequence
  synthetic sequence
cctttcccatagg

SEQ ID NO: 13311 - DNA, 13 bp, Artificial Sequence
  synthetic sequence
gtgatgagatgtt

SEQ ID NO: 13312 - DNA, 13 bp, Artificial Sequence
  synthetic sequence
catgggttttaca

SEQ ID NO: 13313 - DNA, 13 bp, Artificial Sequence
  synthetic sequence
cacgcgagtactg

SEQ ID NO: 13314 - DNA, 13 bp, Artificial Sequence
  synthetic sequence
gtgataggagaac

SEQ ID NO: 13315 - DNA, 13 bp, Artificial Sequence
  synthetic sequence
actggttcaatga

SEQ ID NO: 13316 - DNA, 13 bp, Artificial Sequence
  synthetic sequence
tgataacaccaaa

SEQ ID NO: 13317 - DNA, 13 bp, Artificial Sequence
  synthetic sequence
gccactggacatg

SEQ ID NO: 13318 - DNA, 13 bp, Artificial Sequence
  synthetic sequence
catcagtggttcc

SEQ ID NO: 13319 - DNA, 13 bp, Artificial Sequence
  synthetic sequence
cggtgtgcaagag

SEQ ID NO: 13320 - DNA, 13 bp, Artificial Sequence
  synthetic sequence
gaggttggactag

SEQ ID NO: 13321 - DNA, 13 bp, Artificial Sequence
  synthetic sequence
ttgccgccaatga

SEQ ID NO: 13322 - DNA, 13 bp, Artificial Sequence
  synthetic sequence
accttggagatca

SEQ ID NO: 13323 - DNA, 13 bp, Artificial Sequence
  synthetic sequence
cagtggcgttgac

SEQ ID NO: 13324 - DNA, 13 bp, Artificial Sequence
  synthetic sequence
gacatgacacagt

SEQ ID NO: 13325 - DNA, 13 bp, Artificial Sequence
  synthetic sequence
cggccaaaacacg

SEQ ID NO: 13326 - DNA, 13 bp, Artificial Sequence
  synthetic sequence
gtggacatgacac

SEQ ID NO: 13327 - DNA, 13 bp, Artificial Sequence
  synthetic sequence
atgtgtccttgtt

SEQ ID NO: 13328 - DNA, 13 bp, Artificial Sequence
  synthetic sequence
ggaagacggcatc

SEQ ID NO: 13329 - DNA, 13 bp, Artificial Sequence
  synthetic sequence
cacctaaaaagcg

SEQ ID NO: 13330 - DNA, 13 bp, Artificial Sequence
  synthetic sequence
agagtggcacggt

SEQ ID NO: 13331 - DNA, 13 bp, Artificial Sequence
  synthetic sequence
atggacgtgtaca

SEQ ID NO: 13332 - DNA, 13 bp, Artificial Sequence
  synthetic sequence
gaggcaaagaaga

SEQ ID NO: 13333 - DNA, 13 bp, Artificial Sequence
  synthetic sequence
gggaactaagcca

SEQ ID NO: 13334 - DNA, 13 bp, Artificial Sequence
  synthetic sequence
caaaccccaccat

SEQ ID NO: 13335 - DNA, 13 bp, Artificial Sequence
  synthetic sequence
gatgtgtacaacc

SEQ ID NO: 13336 - DNA, 13 bp, Artificial Sequence
  synthetic sequence
aagcggaccccaa

SEQ ID NO: 13337 - DNA, 13 bp, Artificial Sequence
  synthetic sequence
tatcaggagaacc

SEQ ID NO: 13338 - DNA, 13 bp, Artificial Sequence
  synthetic sequence
ctctaccgtggaa

SEQ ID NO: 13339 - DNA, 13 bp, Artificial Sequence
  synthetic sequence
aagagagaccaga

SEQ ID NO: 13340 - DNA, 13 bp, Artificial Sequence
  synthetic sequence
ggactttggttcc

SEQ ID NO: 13341 - DNA, 13 bp, Artificial Sequence
  synthetic sequence
gtgcagagtcgcc

SEQ ID NO: 13342 - DNA, 13 bp, Artificial Sequence
  synthetic sequence
ccatagtggaagg

SEQ ID NO: 13343 - DNA, 13 bp, Artificial Sequence
  synthetic sequence
tcatttatgtcgg

SEQ ID NO: 13344 - DNA, 13 bp, Artificial Sequence
  synthetic sequence
ggttggactggaa

SEQ ID NO: 13345 - DNA, 13 bp, Artificial Sequence
  synthetic sequence
gtttaatgatttg

SEQ ID NO: 13346 - DNA, 13 bp, Artificial Sequence
  synthetic sequence
gatgtgaatgtgg

SEQ ID NO: 13347 - DNA, 13 bp, Artificial Sequence
  synthetic sequence
ccccaaagatgct

SEQ ID NO: 13348 - DNA, 13 bp, Artificial Sequence
  synthetic sequence
cctgggggtagct

SEQ ID NO: 13349 - DNA, 13 bp, Artificial Sequence
  synthetic sequence
tgtcacacattgt

SEQ ID NO: 13350 - DNA, 13 bp, Artificial Sequence
  synthetic sequence
tgtgccactgccc

SEQ ID NO: 13351 - DNA, 13 bp, Artificial Sequence
  synthetic sequence
catcaatgtgcgc

SEQ ID NO: 13352 - DNA, 13 bp, Artificial Sequence
  synthetic sequence
ctgtgtgcagcgc

SEQ ID NO: 13353 - DNA, 13 bp, Artificial Sequence
  synthetic sequence
tcaaccagtcgct

SEQ ID NO: 13354 - DNA, 13 bp, Artificial Sequence
  synthetic sequence
ggaaggtgttcca

SEQ ID NO: 13355 - DNA, 13 bp, Artificial Sequence
  synthetic sequence
tgtggctcaacct

SEQ ID NO: 13356 - DNA, 13 bp, Artificial Sequence
  synthetic sequence
tgcccttcctggt

SEQ ID NO: 13357 - DNA, 13 bp, Artificial Sequence
  synthetic sequence
ccatagtccccca

SEQ ID NO: 13358 - DNA, 13 bp, Artificial Sequence
  synthetic sequence
ttgccccagcctc

SEQ ID NO: 13359 - DNA, 13 bp, Artificial Sequence
  synthetic sequence
ccgccgaggactg

SEQ ID NO: 13360 - DNA, 13 bp, Artificial Sequence
  synthetic sequence
tcagtctctcgat

SEQ ID NO: 13361 - DNA, 13 bp, Artificial Sequence
  synthetic sequence
atgctgccttttc

SEQ ID NO: 13362 - DNA, 13 bp, Artificial Sequence
  synthetic sequence
gaggagaccgtga

SEQ ID NO: 13363 - DNA, 13 bp, Artificial Sequence
  synthetic sequence
acacgatcttgtt

SEQ ID NO: 13364 - DNA, 13 bp, Artificial Sequence
  synthetic sequence
agctcaagaatga

SEQ ID NO: 13365 - DNA, 13 bp, Artificial Sequence
  synthetic sequence
gagctccaaattc

SEQ ID NO: 13366 - DNA, 13 bp, Artificial Sequence
  synthetic sequence
ttccaaacaatcc

SEQ ID NO: 13367 - DNA, 13 bp, Artificial Sequence
  synthetic sequence
gccacaggaaccc

SEQ ID NO: 13368 - DNA, 13 bp, Artificial Sequence
  synthetic sequence
ctgttgaaggcgc

SEQ ID NO: 13369 - DNA, 13 bp, Artificial Sequence
  synthetic sequence
accgccaaggact

SEQ ID NO: 13370 - DNA, 13 bp, Artificial Sequence
  synthetic sequence
tgttccagagaac

SEQ ID NO: 13371 - DNA, 13 bp, Artificial Sequence
  synthetic sequence
ctccataatcccc

SEQ ID NO: 13372 - DNA, 13 bp, Artificial Sequence
  synthetic sequence
atgtgaacttcgt

SEQ ID NO: 13373 - DNA, 13 bp, Artificial Sequence
  synthetic sequence
ttggcgtcataca

SEQ ID NO: 13374 - DNA, 13 bp, Artificial Sequence
  synthetic sequence
atttctatgaagc

SEQ ID NO: 13375 - DNA, 13 bp, Artificial Sequence
  synthetic sequence
cttttgaaaaacc

SEQ ID NO: 13376 - DNA, 13 bp, Artificial Sequence
  synthetic sequence
gtcggaaggtgtg

SEQ ID NO: 13377 - DNA, 13 bp, Artificial Sequence
  synthetic sequence
caaactcaaccaa

SEQ ID NO: 13378 - DNA, 13 bp, Artificial Sequence
  synthetic sequence
tgagagaagccca

SEQ ID NO: 13379 - DNA, 13 bp, Artificial Sequence
  synthetic sequence
acggaccgacaag

SEQ ID NO: 13380 - DNA, 13 bp, Artificial Sequence
  synthetic sequence
gagagggtctctt

SEQ ID NO: 13381 - DNA, 13 bp, Artificial Sequence
  synthetic sequence
tccgacacgatcc

SEQ ID NO: 13382 - DNA, 13 bp, Artificial Sequence
  synthetic sequence
tggagatcgggct

SEQ ID NO: 13383 - DNA, 13 bp, Artificial Sequence
  synthetic sequence
cgtcaatgccaga

SEQ ID NO: 13384 - DNA, 13 bp, Artificial Sequence
  synthetic sequence
ggcatttgctagg

SEQ ID NO: 13385 - DNA, 13 bp, Artificial Sequence
  synthetic sequence
ccgcagtttgagg

SEQ ID NO: 13386 - DNA, 13 bp, Artificial Sequence
  synthetic sequence
aggcaagtctggc

SEQ ID NO: 13387 - DNA, 13 bp, Artificial Sequence
  synthetic sequence
tggccgaaaaggg

SEQ ID NO: 13388 - DNA, 13 bp, Artificial Sequence
  synthetic sequence
tcgtaaacaggta

SEQ ID NO: 13389 - DNA, 13 bp, Artificial Sequence
  synthetic sequence
taagctgaagaaa

SEQ ID NO: 13390 - DNA, 13 bp, Artificial Sequence
  synthetic sequence
agtcgtcaacggt

SEQ ID NO: 13391 - DNA, 13 bp, Artificial Sequence
  synthetic sequence
ggcacctgccgtc

SEQ ID NO: 13392 - DNA, 13 bp, Artificial Sequence
  synthetic sequence
gcctccacgacga

SEQ ID NO: 13393 - DNA, 13 bp, Artificial Sequence
  synthetic sequence
aagcagttgcaaa

SEQ ID NO: 13394 - DNA, 13 bp, Artificial Sequence
  synthetic sequence
tggtgcgagggga

SEQ ID NO: 13395 - DNA, 13 bp, Artificial Sequence
  synthetic sequence
cccttccatgaat

SEQ ID NO: 13396 - DNA, 13 bp, Artificial Sequence
  synthetic sequence
atgactccagaaa

SEQ ID NO: 13397 - DNA, 13 bp, Artificial Sequence
  synthetic sequence
ccatggataaaaa

SEQ ID NO: 13398 - DNA, 13 bp, Artificial Sequence
  synthetic sequence
gcagatgtagcca

SEQ ID NO: 13399 - DNA, 13 bp, Artificial Sequence
  synthetic sequence
gattccactgttg

SEQ ID NO: 13400 - DNA, 13 bp, Artificial Sequence
  synthetic sequence
agtgcgcagccga

SEQ ID NO: 13401 - DNA, 13 bp, Artificial Sequence
  synthetic sequence
caggctatgctgc

SEQ ID NO: 13402 - DNA, 13 bp, Artificial Sequence
  synthetic sequence
ggtacaaggtgaa

SEQ ID NO: 13403 - DNA, 13 bp, Artificial Sequence
  synthetic sequence
gacaacctggcgg

SEQ ID NO: 13404 - DNA, 13 bp, Artificial Sequence
  synthetic sequence
tgaaaccatccaa

SEQ ID NO: 13405 - DNA, 13 bp, Artificial Sequence
  synthetic sequence
tactcaagagtga

SEQ ID NO: 13406 - DNA, 13 bp, Artificial Sequence
  synthetic sequence
gtggtccgtcagc

SEQ ID NO: 13407 - DNA, 13 bp, Artificial Sequence
  synthetic sequence
ttccattgccgaa

SEQ ID NO: 13408 - DNA, 13 bp, Artificial Sequence
  synthetic sequence
atgaccactgaac

SEQ ID NO: 13409 - DNA, 13 bp, Artificial Sequence
  synthetic sequence
acagtattcagga

SEQ ID NO: 13410 - DNA, 13 bp, Artificial Sequence
  synthetic sequence
aaggcccgtacgc

SEQ ID NO: 13411 - DNA, 13 bp, Artificial Sequence
  synthetic sequence
catactctaccaa

SEQ ID NO: 13412 - DNA, 13 bp, Artificial Sequence
  synthetic sequence
gaagggcagaact

SEQ ID NO: 13413 - DNA, 13 bp, Artificial Sequence
  synthetic sequence
aaagtgcatttta

SEQ ID NO: 13414 - DNA, 13 bp, Artificial Sequence
  synthetic sequence
agcgctcatagcc

SEQ ID NO: 13415 - DNA, 13 bp, Artificial Sequence
  synthetic sequence
ggttctttggact

SEQ ID NO: 13416 - DNA, 13 bp, Artificial Sequence
  synthetic sequence
tgttttacgacaa

SEQ ID NO: 13417 - DNA, 13 bp, Artificial Sequence
  synthetic sequence
gatccgcgcataa

SEQ ID NO: 13418 - DNA, 13 bp, Artificial Sequence
  synthetic sequence
caagaggctgggg

SEQ ID NO: 13419 - DNA, 13 bp, Artificial Sequence
  synthetic sequence
gaggccaatgagc

SEQ ID NO: 13420 - DNA, 13 bp, Artificial Sequence
  synthetic sequence
gcctgaggctacc

SEQ ID NO: 13421 - DNA, 13 bp, Artificial Sequence
  synthetic sequence
atttggaagggac

SEQ ID NO: 13422 - DNA, 13 bp, Artificial Sequence
  synthetic sequence
acaccctggaggg

SEQ ID NO: 13423 - DNA, 13 bp, Artificial Sequence
  synthetic sequence
tgcaagtcgaggc

SEQ ID NO: 13424 - DNA, 13 bp, Artificial Sequence
  synthetic sequence
aggagctcgaggc

SEQ ID NO: 13425 - DNA, 13 bp, Artificial Sequence
  synthetic sequence
gcacatcttggag

SEQ ID NO: 13426 - DNA, 13 bp, Artificial Sequence
  synthetic sequence
ccagcgaaagcat

SEQ ID NO: 13427 - DNA, 13 bp, Artificial Sequence
  synthetic sequence
gtggaggagatat

SEQ ID NO: 13428 - DNA, 13 bp, Artificial Sequence
  synthetic sequence
ggcgaatacctgt

SEQ ID NO: 13429 - DNA, 13 bp, Artificial Sequence
  synthetic sequence
gccattaagctta

SEQ ID NO: 13430 - DNA, 13 bp, Artificial Sequence
  synthetic sequence
catatcattcatg

SEQ ID NO: 13431 - DNA, 13 bp, Artificial Sequence
  synthetic sequence
ctcgtggaaacac

SEQ ID NO: 13432 - DNA, 13 bp, Artificial Sequence
  synthetic sequence
accaggactagaa

SEQ ID NO: 13433 - DNA, 13 bp, Artificial Sequence
  synthetic sequence
agaacgcccgaac

SEQ ID NO: 13434 - DNA, 13 bp, Artificial Sequence
  synthetic sequence
ggcccaacttcaa

SEQ ID NO: 13435 - DNA, 13 bp, Artificial Sequence
  synthetic sequence
tcaagcttagcat

SEQ ID NO: 13436 - DNA, 13 bp, Artificial Sequence
  synthetic sequence
gacgactcttcgg

SEQ ID NO: 13437 - DNA, 13 bp, Artificial Sequence
  synthetic sequence
aagcccagcgagc

SEQ ID NO: 13438 - DNA, 13 bp, Artificial Sequence
  synthetic sequence
ccatcatgaggca

SEQ ID NO: 13439 - DNA, 13 bp, Artificial Sequence
  synthetic sequence
tcatgggccgcct

SEQ ID NO: 13440 - DNA, 13 bp, Artificial Sequence
  synthetic sequence
cagtgaaagcatc

SEQ ID NO: 13441 - DNA, 13 bp, Artificial Sequence
  synthetic sequence
cagcgtcagccga

SEQ ID NO: 13442 - DNA, 13 bp, Artificial Sequence
  synthetic sequence
ggagtgaataggg

SEQ ID NO: 13443 - DNA, 13 bp, Artificial Sequence
  synthetic sequence
cgtatctggaagg

SEQ ID NO: 13444 - DNA, 13 bp, Artificial Sequence
  synthetic sequence
ttgcaacggaggc

SEQ ID NO: 13445 - DNA, 13 bp, Artificial Sequence
  synthetic sequence
tggatttaggtat

SEQ ID NO: 13446 - DNA, 13 bp, Artificial Sequence
  synthetic sequence
cgatcatcatcga

SEQ ID NO: 13447 - DNA, 13 bp, Artificial Sequence
  synthetic sequence
gagactccggagc

SEQ ID NO: 13448 - DNA, 13 bp, Artificial Sequence
  synthetic sequence
tgaataaagaagt

SEQ ID NO: 13449 - DNA, 13 bp, Artificial Sequence
  synthetic sequence
tttaaccacgaga

SEQ ID NO: 13450 - DNA, 13 bp, Artificial Sequence
  synthetic sequence
ctcctctcttgta

SEQ ID NO: 13451 - DNA, 13 bp, Artificial Sequence
  synthetic sequence
gagtgtgttatca

SEQ ID NO: 13452 - DNA, 13 bp, Artificial Sequence
  synthetic sequence
gccactgcttcct

SEQ ID NO: 13453 - DNA, 13 bp, Artificial Sequence
  synthetic sequence
tcaatgtgtctgt

SEQ ID NO: 13454 - DNA, 13 bp, Artificial Sequence
  synthetic sequence
tttcttggcgctc

SEQ ID NO: 13455 - DNA, 13 bp, Artificial Sequence
  synthetic sequence
tcatcggacagat

SEQ ID NO: 13456 - DNA, 13 bp, Artificial Sequence
  synthetic sequence
tctgccaactgtt

SEQ ID NO: 13457 - DNA, 13 bp, Artificial Sequence
  synthetic sequence
tatacatcctggt

SEQ ID NO: 13458 - DNA, 13 bp, Artificial Sequence
  synthetic sequence
ctatggttggtac

SEQ ID NO: 13459 - DNA, 13 bp, Artificial Sequence
  synthetic sequence
ggctgtaaatcga

SEQ ID NO: 13460 - DNA, 13 bp, Artificial Sequence
  synthetic sequence
tgagtggaaatcg

SEQ ID NO: 13461 - DNA, 13 bp, Artificial Sequence
  synthetic sequence
gtcgcaactaact

SEQ ID NO: 13462 - DNA, 13 bp, Artificial Sequence
  synthetic sequence
ctcagagcttgaa

SEQ ID NO: 13463 - DNA, 13 bp, Artificial Sequence
  synthetic sequence
atgctctgcttgc

SEQ ID NO: 13464 - DNA, 13 bp, Artificial Sequence
  synthetic sequence
tatgccagtcatt

SEQ ID NO: 13465 - DNA, 13 bp, Artificial Sequence
  synthetic sequence
attttcttgtcca

SEQ ID NO: 13466 - DNA, 13 bp, Artificial Sequence
  synthetic sequence
acctccgtttcga

SEQ ID NO: 13467 - DNA, 13 bp, Artificial Sequence
  synthetic sequence
agtaatttgttct

SEQ ID NO: 13468 - DNA, 13 bp, Artificial Sequence
  synthetic sequence
cgacggggcattt

SEQ ID NO: 13469 - DNA, 13 bp, Artificial Sequence
  synthetic sequence
gctgccgtcatta

SEQ ID NO: 13470 - DNA, 13 bp, Artificial Sequence
  synthetic sequence
atcaaagtcggat

SEQ ID NO: 13471 - DNA, 13 bp, Artificial Sequence
  synthetic sequence
ctatcctcttctt

SEQ ID NO: 13472 - DNA, 13 bp, Artificial Sequence
  synthetic sequence
tcagcgctcctcc

SEQ ID NO: 13473 - DNA, 13 bp, Artificial Sequence
  synthetic sequence
tttgcatccattc

SEQ ID NO: 13474 - DNA, 13 bp, Artificial Sequence
  synthetic sequence
cctttatcaagcc

SEQ ID NO: 13475 - DNA, 13 bp, Artificial Sequence
  synthetic sequence
tataggctgggag

SEQ ID NO: 13476 - DNA, 13 bp, Artificial Sequence
  synthetic sequence
ggccacatggcat

SEQ ID NO: 13477 - DNA, 13 bp, Artificial Sequence
  synthetic sequence
actatctctgctg

SEQ ID NO: 13478 - DNA, 13 bp, Artificial Sequence
  synthetic sequence
gtaatgagaggtg

SEQ ID NO: 13479 - DNA, 13 bp, Artificial Sequence
  synthetic sequence
aaagaactcttcg

SEQ ID NO: 13480 - DNA, 13 bp, Artificial Sequence
  synthetic sequence
ttctcgtggtaga

SEQ ID NO: 13481 - DNA, 13 bp, Artificial Sequence
  synthetic sequence
gctgccaaaggtg

SEQ ID NO: 13482 - DNA, 13 bp, Artificial Sequence
  synthetic sequence
tatcccagtgatt

SEQ ID NO: 13483 - DNA, 13 bp, Artificial Sequence
  synthetic sequence
gatgaaagcttgt

SEQ ID NO: 13484 - DNA, 13 bp, Artificial Sequence
  synthetic sequence
tgtgggtgttcat

SEQ ID NO: 13485 - DNA, 13 bp, Artificial Sequence
  synthetic sequence
ggacgttcacatg

SEQ ID NO: 13486 - DNA, 13 bp, Artificial Sequence
  synthetic sequence
gccctagcccagt

SEQ ID NO: 13487 - DNA, 13 bp, Artificial Sequence
  synthetic sequence
aagtcacagattt

SEQ ID NO: 13488 - DNA, 13 bp, Artificial Sequence
  synthetic sequence
agcctatccagta

SEQ ID NO: 13489 - DNA, 13 bp, Artificial Sequence
  synthetic sequence
ttcatggtattgg

SEQ ID NO: 13490 - DNA, 13 bp, Artificial Sequence
  synthetic sequence
acaagctttcttg

SEQ ID NO: 13491 - DNA, 13 bp, Artificial Sequence
  synthetic sequence
cctatgttacgag

SEQ ID NO: 13492 - DNA, 13 bp, Artificial Sequence
  synthetic sequence
gtcgcgccagaaa

SEQ ID NO: 13493 - DNA, 13 bp, Artificial Sequence
  synthetic sequence
acttgaactgccg

SEQ ID NO: 13494 - DNA, 13 bp, Artificial Sequence
  synthetic sequence
ctttgttcccgga

SEQ ID NO: 13495 - DNA, 13 bp, Artificial Sequence
  synthetic sequence
tctcgtagtccta

SEQ ID NO: 13496 - DNA, 13 bp, Artificial Sequence
  synthetic sequence
agcactgcctttt

SEQ ID NO: 13497 - DNA, 13 bp, Artificial Sequence
  synthetic sequence
tcactccttcggt

SEQ ID NO: 13498 - DNA, 13 bp, Artificial Sequence
  synthetic sequence
agatcgtcctgct

SEQ ID NO: 13499 - DNA, 13 bp, Artificial Sequence
  synthetic sequence
ttttgcctgggac

SEQ ID NO: 13500 - DNA, 13 bp, Artificial Sequence
  synthetic sequence
gttcaggtgtccc

SEQ ID NO: 13501 - DNA, 13 bp, Artificial Sequence
  synthetic sequence
gacctgctaggag

SEQ ID NO: 13502 - DNA, 13 bp, Artificial Sequence
  synthetic sequence
cttggcccaacac

SEQ ID NO: 13503 - DNA, 13 bp, Artificial Sequence
  synthetic sequence
ttcatgtcataga

SEQ ID NO: 13504 - DNA, 13 bp, Artificial Sequence
  synthetic sequence
agtgacggtgttc

SEQ ID NO: 13505 - DNA, 13 bp, Artificial Sequence
  synthetic sequence
gtcctcacattaa

SEQ ID NO: 13506 - DNA, 13 bp, Artificial Sequence
  synthetic sequence
gtccttacattaa

SEQ ID NO: 13507 - DNA, 13 bp, Artificial Sequence
  synthetic sequence
agtattcatgtca

SEQ ID NO: 13508 - DNA, 13 bp, Artificial Sequence
  synthetic sequence
cctgctaggtgcg

SEQ ID NO: 13509 - DNA, 13 bp, Artificial Sequence
  synthetic sequence
gacctgctgggag

SEQ ID NO: 13510 - DNA, 13 bp, Artificial Sequence
  synthetic sequence
tcagtaccggcac

SEQ ID NO: 13511 - DNA, 13 bp, Artificial Sequence
  synthetic sequence
agatcgtcctgtt

SEQ ID NO: 13512 - DNA, 13 bp, Artificial Sequence
  synthetic sequence
ttgctgttagcag

SEQ ID NO: 13513 - DNA, 13 bp, Artificial Sequence
  synthetic sequence
ccctctgtggatt

SEQ ID NO: 13514 - DNA, 13 bp, Artificial Sequence
  synthetic sequence
gacagcttctccc

SEQ ID NO: 13515 - DNA, 13 bp, Artificial Sequence
  synthetic sequence
gtctcgtagtccg

SEQ ID NO: 13516 - DNA, 13 bp, Artificial Sequence
  synthetic sequence
aagccgcactgtt

SEQ ID NO: 13517 - DNA, 13 bp, Artificial Sequence
  synthetic sequence
ttcggcttacata

SEQ ID NO: 13518 - DNA, 13 bp, Artificial Sequence
  synthetic sequence
gttcaatgattgg

SEQ ID NO: 13519 - DNA, 13 bp, Artificial Sequence
  synthetic sequence
tccataacgtcgg

SEQ ID NO: 13520 - DNA, 13 bp, Artificial Sequence
  synthetic sequence
tccttgcgaagta

SEQ ID NO: 13521 - DNA, 13 bp, Artificial Sequence
  synthetic sequence
tggagtcctcacg

SEQ ID NO: 13522 - DNA, 13 bp, Artificial Sequence
  synthetic sequence
ctagccctgctag

SEQ ID NO: 13523 - DNA, 13 bp, Artificial Sequence
  synthetic sequence
ttcagcaccggca

SEQ ID NO: 13524 - DNA, 13 bp, Artificial Sequence
  synthetic sequence
aggtgacgtagta

SEQ ID NO: 13525 - DNA, 13 bp, Artificial Sequence
  synthetic sequence
tctgaaccgtggt

SEQ ID NO: 13526 - DNA, 13 bp, Artificial Sequence
  synthetic sequence
gtcgaccaagaat

SEQ ID NO: 13527 - DNA, 13 bp, Artificial Sequence
  synthetic sequence
gatgaaaccactc

SEQ ID NO: 13528 - DNA, 13 bp, Artificial Sequence
  synthetic sequence
tattcaagcatcc

SEQ ID NO: 13529 - DNA, 13 bp, Artificial Sequence
  synthetic sequence
agagtctgggccc

SEQ ID NO: 13530 - DNA, 13 bp, Artificial Sequence
  synthetic sequence
tgcgggtccctcg

SEQ ID NO: 13531 - DNA, 13 bp, Artificial Sequence
  synthetic sequence
ggagcctctgcga

SEQ ID NO: 13532 - DNA, 13 bp, Artificial Sequence
  synthetic sequence
catcggaattaac

SEQ ID NO: 13533 - DNA, 13 bp, Artificial Sequence
  synthetic sequence
ggatcttattagg

SEQ ID NO: 13534 - DNA, 13 bp, Artificial Sequence
  synthetic sequence
gagaacacacaac

SEQ ID NO: 13535 - DNA, 13 bp, Artificial Sequence
  synthetic sequence
gcagtccagtatg

SEQ ID NO: 13536 - DNA, 13 bp, Artificial Sequence
  synthetic sequence
cgatgacttcaca

SEQ ID NO: 13537 - DNA, 13 bp, Artificial Sequence
  synthetic sequence
gaacgtcgacaat

SEQ ID NO: 13538 - DNA, 13 bp, Artificial Sequence
  synthetic sequence
caatgtcctccag

SEQ ID NO: 13539 - DNA, 13 bp, Artificial Sequence
  synthetic sequence
acgtcccctacac

SEQ ID NO: 13540 - DNA, 13 bp, Artificial Sequence
  synthetic sequence
acacgcctacagt

SEQ ID NO: 13541 - DNA, 13 bp, Artificial Sequence
  synthetic sequence
caccaacaatttt

SEQ ID NO: 13542 - DNA, 13 bp, Artificial Sequence
  synthetic sequence
agcccacaagcaa

SEQ ID NO: 13543 - DNA, 13 bp, Artificial Sequence
  synthetic sequence
taggaggtgcaaa

SEQ ID NO: 13544 - DNA, 13 bp, Artificial Sequence
  synthetic sequence
gacgccttcgaac

SEQ ID NO: 13545 - DNA, 13 bp, Artificial Sequence
  synthetic sequence
accgtttctctgg

SEQ ID NO: 13546 - DNA, 13 bp, Artificial Sequence
  synthetic sequence
tgcgagcagacgc

SEQ ID NO: 13547 - DNA, 13 bp, Artificial Sequence
  synthetic sequence
aagtcggcctgcg

SEQ ID NO: 13548 - DNA, 13 bp, Artificial Sequence
  synthetic sequence
gcgtggtgcataa

SEQ ID NO: 13549 - DNA, 13 bp, Artificial Sequence
  synthetic sequence
ttagaatccaggt

SEQ ID NO: 13550 - DNA, 13 bp, Artificial Sequence
  synthetic sequence
aacacacgtagat

SEQ ID NO: 13551 - DNA, 13 bp, Artificial Sequence
  synthetic sequence
gggacattgtcca

SEQ ID NO: 13552 - DNA, 13 bp, Artificial Sequence
  synthetic sequence
gcgactacagcac

SEQ ID NO: 13553 - DNA, 13 bp, Artificial Sequence
  synthetic sequence
gggccgatatcag

SEQ ID NO: 13554 - DNA, 13 bp, Artificial Sequence
  synthetic sequence
gtacccacagcat

SEQ ID NO: 13555 - DNA, 13 bp, Artificial Sequence
  synthetic sequence
ctaatccgccgcc

SEQ ID NO: 13556 - DNA, 13 bp, Artificial Sequence
  synthetic sequence
gacgttccccaga

SEQ ID NO: 13557 - DNA, 13 bp, Artificial Sequence
  synthetic sequence
gtagagaggagta

SEQ ID NO: 13558 - DNA, 13 bp, Artificial Sequence
  synthetic sequence
aggaagcgtcagg

SEQ ID NO: 13559 - DNA, 13 bp, Artificial Sequence
  synthetic sequence
caaaccctcctag

SEQ ID NO: 13560 - DNA, 13 bp, Artificial Sequence
  synthetic sequence
ggtaggcactgca

SEQ ID NO: 13561 - DNA, 13 bp, Artificial Sequence
  synthetic sequence
gacatcaaggaag

SEQ ID NO: 13562 - DNA, 13 bp, Artificial Sequence
  synthetic sequence
aagcctaaaccag

SEQ ID NO: 13563 - DNA, 13 bp, Artificial Sequence
  synthetic sequence
caacactatatca

SEQ ID NO: 13564 - DNA, 13 bp, Artificial Sequence
  synthetic sequence
aacgcaagcctaa

SEQ ID NO: 13565 - DNA, 13 bp, Artificial Sequence
  synthetic sequence
gacagcgtatgtg

SEQ ID NO: 13566 - DNA, 13 bp, Artificial Sequence
  synthetic sequence
cgaccacgaccat

SEQ ID NO: 13567 - DNA, 13 bp, Artificial Sequence
  synthetic sequence
tttataagactca

SEQ ID NO: 13568 - DNA, 13 bp, Artificial Sequence
  synthetic sequence
ggtggtttgtcgc

SEQ ID NO: 13569 - DNA, 13 bp, Artificial Sequence
  synthetic sequence
cattcgtaggtga

SEQ ID NO: 13570 - DNA, 13 bp, Artificial Sequence
  synthetic sequence
atgaaagggtaca

SEQ ID NO: 13571 - DNA, 13 bp, Artificial Sequence
  synthetic sequence
tcggccggtggtt

SEQ ID NO: 13572 - DNA, 13 bp, Artificial Sequence
  synthetic sequence
tatgtcagtgcgg

SEQ ID NO: 13573 - DNA, 13 bp, Artificial Sequence
  synthetic sequence
ttctttttaggct

SEQ ID NO: 13574 - DNA, 13 bp, Artificial Sequence
  synthetic sequence
gcaggggtcgtcc

SEQ ID NO: 13575 - DNA, 13 bp, Artificial Sequence
  synthetic sequence
gcaggtcacgtac

SEQ ID NO: 13576 - DNA, 13 bp, Artificial Sequence
  synthetic sequence
acctcctaagatc

SEQ ID NO: 13577 - DNA, 13 bp, Artificial Sequence
  synthetic sequence
gatcggaaatgtc

SEQ ID NO: 13578 - DNA, 13 bp, Artificial Sequence
  synthetic sequence
tgatgacgacctt

SEQ ID NO: 13579 - DNA, 13 bp, Artificial Sequence
  synthetic sequence
atacgtactccag

SEQ ID NO: 13580 - DNA, 13 bp, Artificial Sequence
  synthetic sequence
tttattgggctga

SEQ ID NO: 13581 - DNA, 13 bp, Artificial Sequence
  synthetic sequence
cagtgcaagcagc

SEQ ID NO: 13582 - DNA, 13 bp, Artificial Sequence
  synthetic sequence
tgtaggcaatgca

SEQ ID NO: 13583 - DNA, 13 bp, Artificial Sequence
  synthetic sequence
tgtcaatcgagat

SEQ ID NO: 13584 - DNA, 13 bp, Artificial Sequence
  synthetic sequence
gtgttatgctgcc

SEQ ID NO: 13585 - DNA, 13 bp, Artificial Sequence
  synthetic sequence
atttcaagacgtt

SEQ ID NO: 13586 - DNA, 13 bp, Artificial Sequence
  synthetic sequence
ttgcagtcaggtg

SEQ ID NO: 13587 - DNA, 13 bp, Artificial Sequence
  synthetic sequence
cgcgtatggcgtc

SEQ ID NO: 13588 - DNA, 13 bp, Artificial Sequence
  synthetic sequence
tcagctttgtact

SEQ ID NO: 13589 - DNA, 13 bp, Artificial Sequence
  synthetic sequence
ccttcttcaattt

SEQ ID NO: 13590 - DNA, 13 bp, Artificial Sequence
  synthetic sequence
cttatacgggatc

SEQ ID NO: 13591 - DNA, 13 bp, Artificial Sequence
  synthetic sequence
ctttgtggccaag

SEQ ID NO: 13592 - DNA, 13 bp, Artificial Sequence
  synthetic sequence
atgccgatgataa

SEQ ID NO: 13593 - DNA, 13 bp, Artificial Sequence
  synthetic sequence
agtacatcgagtt

SEQ ID NO: 13594 - DNA, 13 bp, Artificial Sequence
  synthetic sequence
ctgcacagcatta

SEQ ID NO: 13595 - DNA, 13 bp, Artificial Sequence
  synthetic sequence
gcctgcctgattg

SEQ ID NO: 13596 - DNA, 13 bp, Artificial Sequence
  synthetic sequence
aagcagcggaaca

SEQ ID NO: 13597 - DNA, 13 bp, Artificial Sequence
  synthetic sequence
tggttccaagtga

SEQ ID NO: 13598 - DNA, 13 bp, Artificial Sequence
  synthetic sequence
agcgaactcgacg

SEQ ID NO: 13599 - DNA, 13 bp, Artificial Sequence
  synthetic sequence
cgtgaggaacctg

SEQ ID NO: 13600 - DNA, 13 bp, Artificial Sequence
  synthetic sequence
caaagtttctcca

SEQ ID NO: 13601 - DNA, 13 bp, Artificial Sequence
  synthetic sequence
cggcagacgtctc

SEQ ID NO: 13602 - DNA, 13 bp, Artificial Sequence
  synthetic sequence
gtgtcaagcggaa

SEQ ID NO: 13603 - DNA, 13 bp, Artificial Sequence
  synthetic sequence
ctccacggtgcat

SEQ ID NO: 13604 - DNA, 13 bp, Artificial Sequence
  synthetic sequence
ctctgcctctgtt

SEQ ID NO: 13605 - DNA, 13 bp, Artificial Sequence
  synthetic sequence
ggtggtttgtcac

SEQ ID NO: 13606 - DNA, 13 bp, Artificial Sequence
  synthetic sequence
aacttcctcctga

SEQ ID NO: 13607 - DNA, 13 bp, Artificial Sequence
  synthetic sequence
ctgtcgcctttcc

SEQ ID NO: 13608 - DNA, 13 bp, Artificial Sequence
  synthetic sequence
tcagcaacgggta

SEQ ID NO: 13609 - DNA, 13 bp, Artificial Sequence
  synthetic sequence
gccatcgtggtgg

SEQ ID NO: 13610 - DNA, 13 bp, Artificial Sequence
  synthetic sequence
tgggagatgctac

SEQ ID NO: 13611 - DNA, 13 bp, Artificial Sequence
  synthetic sequence
tccatgaaaatga

SEQ ID NO: 13612 - DNA, 13 bp, Artificial Sequence
  synthetic sequence
acggttcaacagc

SEQ ID NO: 13613 - DNA, 13 bp, Artificial Sequence
  synthetic sequence
tgaagtggacaaa

SEQ ID NO: 13614 - DNA, 13 bp, Artificial Sequence
  synthetic sequence
atccaaatgatca

SEQ ID NO: 13615 - DNA, 13 bp, Artificial Sequence
  synthetic sequence
ggacaatttgctt

SEQ ID NO: 13616 - DNA, 13 bp, Artificial Sequence
  synthetic sequence
gctgcccaaagaa

SEQ ID NO: 13617 - DNA, 13 bp, Artificial Sequence
  synthetic sequence
atgaaggaaatgc

SEQ ID NO: 13618 - DNA, 13 bp, Artificial Sequence
  synthetic sequence
atgatgactttct

SEQ ID NO: 13619 - DNA, 13 bp, Artificial Sequence
  synthetic sequence
tcttcggctggtt

SEQ ID NO: 13620 - DNA, 13 bp, Artificial Sequence
  synthetic sequence
cagctatgaaaga

SEQ ID NO: 13621 - DNA, 13 bp, Artificial Sequence
  synthetic sequence
tgcagaaccgcgt

SEQ ID NO: 13622 - DNA, 13 bp, Artificial Sequence
  synthetic sequence
gcggtgatcctga

SEQ ID NO: 13623 - DNA, 13 bp, Artificial Sequence
  synthetic sequence
tgggtgatcgcca

SEQ ID NO: 13624 - DNA, 13 bp, Artificial Sequence
  synthetic sequence
aaaggtaagtata

SEQ ID NO: 13625 - DNA, 13 bp, Artificial Sequence
  synthetic sequence
cagaacgcccagg

SEQ ID NO: 13626 - DNA, 13 bp, Artificial Sequence
  synthetic sequence
ggccgatcttcgc

SEQ ID NO: 13627 - DNA, 13 bp, Artificial Sequence
  synthetic sequence
gcgttcttcgccg

SEQ ID NO: 13628 - DNA, 13 bp, Artificial Sequence
  synthetic sequence
attttacaaccag

SEQ ID NO: 13629 - DNA, 13 bp, Artificial Sequence
  synthetic sequence
aaggcaagtatat

SEQ ID NO: 13630 - DNA, 13 bp, Artificial Sequence
  synthetic sequence
ggtttgttgagaa

SEQ ID NO: 13631 - DNA, 13 bp, Artificial Sequence
  synthetic sequence
caggtgcagaaca

SEQ ID NO: 13632 - DNA, 13 bp, Artificial Sequence
  synthetic sequence
ataatgtctatgc

SEQ ID NO: 13633 - DNA, 13 bp, Artificial Sequence
  synthetic sequence
atccgcgagcaga

SEQ ID NO: 13634 - DNA, 13 bp, Artificial Sequence
  synthetic sequence
aaggaaagtacat

SEQ ID NO: 13635 - DNA, 13 bp, Artificial Sequence
  synthetic sequence
cgacgatcaggat

SEQ ID NO: 13636 - DNA, 13 bp, Artificial Sequence
  synthetic sequence
ttttctcaagggt

SEQ ID NO: 13637 - DNA, 13 bp, Artificial Sequence
  synthetic sequence
catacctggatta

SEQ ID NO: 13638 - DNA, 13 bp, Artificial Sequence
  synthetic sequence
atggccgagctga

SEQ ID NO: 13639 - DNA, 13 bp, Artificial Sequence
  synthetic sequence
gttgacgcaggaa

SEQ ID NO: 13640 - DNA, 13 bp, Artificial Sequence
  synthetic sequence
ttgatgcagatac

SEQ ID NO: 13641 - DNA, 13 bp, Artificial Sequence
  synthetic sequence
taaccgatatgat

SEQ ID NO: 13642 - DNA, 13 bp, Artificial Sequence
  synthetic sequence
ggagaatttgcca

SEQ ID NO: 13643 - DNA, 13 bp, Artificial Sequence
  synthetic sequence
ccatcaggaagct

SEQ ID NO: 13644 - DNA, 13 bp, Artificial Sequence
  synthetic sequence
aagtcgtattgcg

SEQ ID NO: 13645 - DNA, 13 bp, Artificial Sequence
  synthetic sequence
ccatcgtcgtggt

SEQ ID NO: 13646 - DNA, 13 bp, Artificial Sequence
  synthetic sequence
ccgttaacggctt

SEQ ID NO: 13647 - DNA, 13 bp, Artificial Sequence
  synthetic sequence
ctgaagatgcgac

SEQ ID NO: 13648 - DNA, 13 bp, Artificial Sequence
  synthetic sequence
aatcctgtttcca

SEQ ID NO: 13649 - DNA, 13 bp, Artificial Sequence
  synthetic sequence
tacgcagcagggc

SEQ ID NO: 13650 - DNA, 13 bp, Artificial Sequence
  synthetic sequence
gctgtacaaggaa

SEQ ID NO: 13651 - DNA, 13 bp, Artificial Sequence
  synthetic sequence
tactaacaatcag

SEQ ID NO: 13652 - DNA, 13 bp, Artificial Sequence
  synthetic sequence
atcaaagtaacta

SEQ ID NO: 13653 - DNA, 13 bp, Artificial Sequence
  synthetic sequence
ctgaatcacaatt

SEQ ID NO: 13654 - DNA, 13 bp, Artificial Sequence
  synthetic sequence
tcctgattttatc

SEQ ID NO: 13655 - DNA, 13 bp, Artificial Sequence
  synthetic sequence
ttctgcgcgacgt

SEQ ID NO: 13656 - DNA, 13 bp, Artificial Sequence
  synthetic sequence
ccaacctttgatg

SEQ ID NO: 13657 - DNA, 13 bp, Artificial Sequence
  synthetic sequence
gcatgtcgtagcg

SEQ ID NO: 13658 - DNA, 13 bp, Artificial Sequence
  synthetic sequence
ggcggcctatcga

SEQ ID NO: 13659 - DNA, 13 bp, Artificial Sequence
  synthetic sequence
ctgagtttattat

SEQ ID NO: 13660 - DNA, 13 bp, Artificial Sequence
  synthetic sequence
tattcttgcaggg

SEQ ID NO: 13661 - DNA, 13 bp, Artificial Sequence
  synthetic sequence
atgcaaatgaaga

SEQ ID NO: 13662 - DNA, 13 bp, Artificial Sequence
  synthetic sequence
gacgatgcgatcg

SEQ ID NO: 13663 - DNA, 13 bp, Artificial Sequence
  synthetic sequence
aatactggcctga

SEQ ID NO: 13664 - DNA, 13 bp, Artificial Sequence
  synthetic sequence
agtcctgtaagta

SEQ ID NO: 13665 - DNA, 13 bp, Artificial Sequence
  synthetic sequence
tgaagatgcagca

SEQ ID NO: 13666 - DNA, 13 bp, Artificial Sequence
  synthetic sequence
ttctcgaactctt

SEQ ID NO: 13667 - DNA, 13 bp, Artificial Sequence
  synthetic sequence
ttattacacatgc

SEQ ID NO: 13668 - DNA, 13 bp, Artificial Sequence
  synthetic sequence
gcgggaggaacag

SEQ ID NO: 13669 - DNA, 13 bp, Artificial Sequence
  synthetic sequence
gctgaagcagccg

SEQ ID NO: 13670 - DNA, 13 bp, Artificial Sequence
  synthetic sequence
agaggtctttcat

SEQ ID NO: 13671 - DNA, 13 bp, Artificial Sequence
  synthetic sequence
agtattgtttatc

SEQ ID NO: 13672 - DNA, 13 bp, Artificial Sequence
  synthetic sequence
caacaattggaaa

SEQ ID NO: 13673 - DNA, 13 bp, Artificial Sequence
  synthetic sequence
gtgtgcaagcaca

SEQ ID NO: 13674 - DNA, 13 bp, Artificial Sequence
  synthetic sequence
gggttatcggtgc

SEQ ID NO: 13675 - DNA, 13 bp, Artificial Sequence
  synthetic sequence
aagcgcgtcagtt

SEQ ID NO: 13676 - DNA, 13 bp, Artificial Sequence
  synthetic sequence
ttttcgcctgggt

SEQ ID NO: 13677 - DNA, 13 bp, Artificial Sequence
  synthetic sequence
tgatcgagcccgg

SEQ ID NO: 13678 - DNA, 13 bp, Artificial Sequence
  synthetic sequence
ttctttggctggt

SEQ ID NO: 13679 - DNA, 13 bp, Artificial Sequence
  synthetic sequence
ggctgtgaggtcg

SEQ ID NO: 13680 - DNA, 13 bp, Artificial Sequence
  synthetic sequence
gactggctcacgc

SEQ ID NO: 13681 - DNA, 13 bp, Artificial Sequence
  synthetic sequence
tcttcatcgatcg

SEQ ID NO: 13682 - DNA, 13 bp, Artificial Sequence
  synthetic sequence
accaccagcacca

SEQ ID NO: 13683 - DNA, 13 bp, Artificial Sequence
  synthetic sequence
atccgatctacgt

SEQ ID NO: 13684 - DNA, 13 bp, Artificial Sequence
  synthetic sequence
gcgagatgatccc

SEQ ID NO: 13685 - DNA, 13 bp, Artificial Sequence
  synthetic sequence
cgtattcgccgga

SEQ ID NO: 13686 - DNA, 13 bp, Artificial Sequence
  synthetic sequence
tcatcgcccgctt

SEQ ID NO: 13687 - DNA, 13 bp, Artificial Sequence
  synthetic sequence
cagaactacttcg

SEQ ID NO: 13688 - DNA, 13 bp, Artificial Sequence
  synthetic sequence
aaagatgcagcta

SEQ ID NO: 13689 - DNA, 13 bp, Artificial Sequence
  synthetic sequence
tggtcgatgacgc

SEQ ID NO: 13690 - DNA, 13 bp, Artificial Sequence
  synthetic sequence
tcatttggacaag

SEQ ID NO: 13691 - DNA, 13 bp, Artificial Sequence
  synthetic sequence
cgctacaacggct

SEQ ID NO: 13692 - DNA, 13 bp, Artificial Sequence
  synthetic sequence
gcggcgttcttcc

SEQ ID NO: 13693 - DNA, 13 bp, Artificial Sequence
  synthetic sequence
ctgatcagcaagc

SEQ ID NO: 13694 - DNA, 13 bp, Artificial Sequence
  synthetic sequence
cggatatgtattc

SEQ ID NO: 13695 - DNA, 13 bp, Artificial Sequence
  synthetic sequence
tgccatgaagccg

SEQ ID NO: 13696 - DNA, 13 bp, Artificial Sequence
  synthetic sequence
ctaacagaagcta

SEQ ID NO: 13697 - DNA, 13 bp, Artificial Sequence
  synthetic sequence
tggtatattctgc

SEQ ID NO: 13698 - DNA, 13 bp, Artificial Sequence
  synthetic sequence
ggatacccgccat

SEQ ID NO: 13699 - DNA, 13 bp, Artificial Sequence
  synthetic sequence
acccaacgaccta

SEQ ID NO: 13700 - DNA, 13 bp, Artificial Sequence
  synthetic sequence
acgacagaatctt

SEQ ID NO: 13701 - DNA, 13 bp, Artificial Sequence
  synthetic sequence
ttcaggtccagaa

SEQ ID NO: 13702 - DNA, 13 bp, Artificial Sequence
  synthetic sequence
aagtgcagaaccg

SEQ ID NO: 13703 - DNA, 13 bp, Artificial Sequence
  synthetic sequence
ccccaaataacat

SEQ ID NO: 13704 - DNA, 13 bp, Artificial Sequence
  synthetic sequence
ctatgtataatca

SEQ ID NO: 13705 - DNA, 13 bp, Artificial Sequence
  synthetic sequence
acgcgacgagcac

SEQ ID NO: 13706 - DNA, 13 bp, Artificial Sequence
  synthetic sequence
aggagatcaaccg

SEQ ID NO: 13707 - DNA, 13 bp, Artificial Sequence
  synthetic sequence
acgttaatgaagg

SEQ ID NO: 13708 - DNA, 13 bp, Artificial Sequence
  synthetic sequence
gtgtcgaagatgt

SEQ ID NO: 13709 - DNA, 13 bp, Artificial Sequence
  synthetic sequence
cgtatagccgagg

SEQ ID NO: 13710 - DNA, 13 bp, Artificial Sequence
  synthetic sequence
caaatttcataag

SEQ ID NO: 13711 - DNA, 13 bp, Artificial Sequence
  synthetic sequence
gcgatccggtcac

SEQ ID NO: 13712 - DNA, 13 bp, Artificial Sequence
  synthetic sequence
tttccggcgtcgg

SEQ ID NO: 13713 - DNA, 13 bp, Artificial Sequence
  synthetic sequence
tttgcggttaacg

SEQ ID NO: 13714 - DNA, 13 bp, Artificial Sequence
  synthetic sequence
atttggtgttccg

SEQ ID NO: 13715 - DNA, 13 bp, Artificial Sequence
  synthetic sequence
ggcattactgttt

SEQ ID NO: 13716 - DNA, 13 bp, Artificial Sequence
  synthetic sequence
attgttcggacag

SEQ ID NO: 13717 - DNA, 13 bp, Artificial Sequence
  synthetic sequence
catggcttcgccg

SEQ ID NO: 13718 - DNA, 13 bp, Artificial Sequence
  synthetic sequence
catcgccttgacc

SEQ ID NO: 13719 - DNA, 13 bp, Artificial Sequence
  synthetic sequence
tggcgttcttggc

SEQ ID NO: 13720 - DNA, 13 bp, Artificial Sequence
  synthetic sequence
atggaaccgttct

SEQ ID NO: 13721 - DNA, 13 bp, Artificial Sequence
  synthetic sequence
tataaagaagaag

SEQ ID NO: 13722 - DNA, 13 bp, Artificial Sequence
  synthetic sequence
tgggtaaatattt

SEQ ID NO: 13723 - DNA, 13 bp, Artificial Sequence
  synthetic sequence
caggattacttcc

SEQ ID NO: 13724 - DNA, 13 bp, Artificial Sequence
  synthetic sequence
gcacgcggatcgt

SEQ ID NO: 13725 - DNA, 13 bp, Artificial Sequence
  synthetic sequence
gatgtctttcggt

SEQ ID NO: 13726 - DNA, 13 bp, Artificial Sequence
  synthetic sequence
cgacgacgcgatc

SEQ ID NO: 13727 - DNA, 13 bp, Artificial Sequence
  synthetic sequence
cttcaccggtact

SEQ ID NO: 13728 - DNA, 13 bp, Artificial Sequence
  synthetic sequence
caacacccttaat

SEQ ID NO: 13729 - DNA, 13 bp, Artificial Sequence
  synthetic sequence
tacggcgaagggc

SEQ ID NO: 13730 - DNA, 13 bp, Artificial Sequence
  synthetic sequence
tggatctgctcca

SEQ ID NO: 13731 - DNA, 13 bp, Artificial Sequence
  synthetic sequence
cgcgaggtgtcgt

SEQ ID NO: 13732 - DNA, 13 bp, Artificial Sequence
  synthetic sequence
cagaacttcctcg

SEQ ID NO: 13733 - DNA, 13 bp, Artificial Sequence
  synthetic sequence
ggggttatcggcg

SEQ ID NO: 13734 - DNA, 13 bp, Artificial Sequence
  synthetic sequence
tgatgaccttttc

SEQ ID NO: 13735 - DNA, 13 bp, Artificial Sequence
  synthetic sequence
tgtcgaaatggcg

SEQ ID NO: 13736 - DNA, 13 bp, Artificial Sequence
  synthetic sequence
tctatgttgacgt

SEQ ID NO: 13737 - DNA, 13 bp, Artificial Sequence
  synthetic sequence
tgcaggaaggttt

SEQ ID NO: 13738 - DNA, 13 bp, Artificial Sequence
  synthetic sequence
gcgtagttgcgca

SEQ ID NO: 13739 - DNA, 13 bp, Artificial Sequence
  synthetic sequence
accatacgtggat

SEQ ID NO: 13740 - DNA, 13 bp, Artificial Sequence
  synthetic sequence
tgcgtcaggtcac

SEQ ID NO: 13741 - DNA, 13 bp, Artificial Sequence
  synthetic sequence
accacttcgttaa

SEQ ID NO: 13742 - DNA, 13 bp, Artificial Sequence
  synthetic sequence
tgatgttcgccgg

SEQ ID NO: 13743 - DNA, 13 bp, Artificial Sequence
  synthetic sequence
accagataacggc

SEQ ID NO: 13744 - DNA, 13 bp, Artificial Sequence
  synthetic sequence
ctggtctgctcga

SEQ ID NO: 13745 - DNA, 13 bp, Artificial Sequence
  synthetic sequence
tgcactggcggtt

SEQ ID NO: 13746 - DNA, 13 bp, Artificial Sequence
  synthetic sequence
acagtggtaaagg

SEQ ID NO: 13747 - DNA, 13 bp, Artificial Sequence
  synthetic sequence
caacaacgcaacg

SEQ ID NO: 13748 - DNA, 13 bp, Artificial Sequence
  synthetic sequence
ccaacgttgaatc

SEQ ID NO: 13749 - DNA, 13 bp, Artificial Sequence
  synthetic sequence
gcgaaccagaacc

SEQ ID NO: 13750 - DNA, 13 bp, Artificial Sequence
  synthetic sequence
aaggcgatctggc

SEQ ID NO: 13751 - DNA, 13 bp, Artificial Sequence
  synthetic sequence
tggtattgatatc

SEQ ID NO: 13752 - DNA, 13 bp, Artificial Sequence
  synthetic sequence
gacgcgattgtgg

SEQ ID NO: 13753 - DNA, 13 bp, Artificial Sequence
  synthetic sequence
accctctgatgtc

SEQ ID NO: 13754 - DNA, 13 bp, Artificial Sequence
  synthetic sequence
gccgattataccg

SEQ ID NO: 13755 - DNA, 13 bp, Artificial Sequence
  synthetic sequence
ttgaattgtccgg

SEQ ID NO: 13756 - DNA, 13 bp, Artificial Sequence
  synthetic sequence
tagcccgtaaacg

SEQ ID NO: 13757 - DNA, 13 bp, Artificial Sequence
  synthetic sequence
taaatctggtctt

SEQ ID NO: 13758 - DNA, 13 bp, Artificial Sequence
  synthetic sequence
tcgaagaatggag

SEQ ID NO: 13759 - DNA, 13 bp, Artificial Sequence
  synthetic sequence
tggagttaattgc

SEQ ID NO: 13760 - DNA, 13 bp, Artificial Sequence
  synthetic sequence
cggttcctcgaca

SEQ ID NO: 13761 - DNA, 13 bp, Artificial Sequence
  synthetic sequence
ggccgatctttgc

SEQ ID NO: 13762 - DNA, 13 bp, Artificial Sequence
  synthetic sequence
ggttcaggtgcaa

SEQ ID NO: 13763 - DNA, 13 bp, Artificial Sequence
  synthetic sequence
aacgcgagcggca

SEQ ID NO: 13764 - DNA, 13 bp, Artificial Sequence
  synthetic sequence
ccttgaccgaacg

SEQ ID NO: 13765 - DNA, 13 bp, Artificial Sequence
  synthetic sequence
gaacacgatcacg

SEQ ID NO: 13766 - DNA, 13 bp, Artificial Sequence
  synthetic sequence
ggctgaactcttc

SEQ ID NO: 13767 - DNA, 13 bp, Artificial Sequence
  synthetic sequence
tagcaatttctaa

SEQ ID NO: 13768 - DNA, 13 bp, Artificial Sequence
  synthetic sequence
agaccgccaagag

SEQ ID NO: 13769 - DNA, 13 bp, Artificial Sequence
  synthetic sequence
gccagggctcaac

SEQ ID NO: 13770 - DNA, 13 bp, Artificial Sequence
  synthetic sequence
tcaccgcgtctgg

SEQ ID NO: 13771 - DNA, 13 bp, Artificial Sequence
  synthetic sequence
gctagtcctgtta

SEQ ID NO: 13772 - DNA, 13 bp, Artificial Sequence
  synthetic sequence
acccacgatccgc

SEQ ID NO: 13773 - DNA, 13 bp, Artificial Sequence
  synthetic sequence
tcagaatcgcgtt

SEQ ID NO: 13774 - DNA, 13 bp, Artificial Sequence
  synthetic sequence
cctacgcacctcc

SEQ ID NO: 13775 - DNA, 13 bp, Artificial Sequence
  synthetic sequence
gccatccccatca

SEQ ID NO: 13776 - DNA, 13 bp, Artificial Sequence
  synthetic sequence
tgcgcgattttcg

SEQ ID NO: 13777 - DNA, 13 bp, Artificial Sequence
  synthetic sequence
gcgcttttcgcag

SEQ ID NO: 13778 - DNA, 13 bp, Artificial Sequence
  synthetic sequence
cgattgcggaaaa

SEQ ID NO: 13779 - DNA, 13 bp, Artificial Sequence
  synthetic sequence
atcgaccgcgcca

SEQ ID NO: 13780 - DNA, 13 bp, Artificial Sequence
  synthetic sequence
tgctggtcggcgt

SEQ ID NO: 13781 - DNA, 13 bp, Artificial Sequence
  synthetic sequence
agcaacgatgcct

SEQ ID NO: 13782 - DNA, 13 bp, Artificial Sequence
  synthetic sequence
cggtcgatgtcga

SEQ ID NO: 13783 - DNA, 13 bp, Artificial Sequence
  synthetic sequence
tcaataccattcc

SEQ ID NO: 13784 - DNA, 13 bp, Artificial Sequence
  synthetic sequence
acgacttcatcaa

SEQ ID NO: 13785 - DNA, 13 bp, Artificial Sequence
  synthetic sequence
tgaaaaggcagag

SEQ ID NO: 13786 - DNA, 13 bp, Artificial Sequence
  synthetic sequence
gtatggggattag

SEQ ID NO: 13787 - DNA, 13 bp, Artificial Sequence
  synthetic sequence
acctggaagtaaa

SEQ ID NO: 13788 - DNA, 13 bp, Artificial Sequence
  synthetic sequence
ggctgctcagagg

SEQ ID NO: 13789 - DNA, 13 bp, Artificial Sequence
  synthetic sequence
tcgcttttaatac

SEQ ID NO: 13790 - DNA, 13 bp, Artificial Sequence
  synthetic sequence
gtcacctacgtgc

SEQ ID NO: 13791 - DNA, 13 bp, Artificial Sequence
  synthetic sequence
ctcgtcgcgttcc

SEQ ID NO: 13792 - DNA, 13 bp, Artificial Sequence
  synthetic sequence
cctctgcggcagt

SEQ ID NO: 13793 - DNA, 13 bp, Artificial Sequence
  synthetic sequence
aatcctatcttgg

SEQ ID NO: 13794 - DNA, 13 bp, Artificial Sequence
  synthetic sequence
tgatcgaggcgtt

SEQ ID NO: 13795 - DNA, 13 bp, Artificial Sequence
  synthetic sequence
atgaaaagtgcat

SEQ ID NO: 13796 - DNA, 13 bp, Artificial Sequence
  synthetic sequence
tgatcatattcat

SEQ ID NO: 13797 - DNA, 13 bp, Artificial Sequence
  synthetic sequence
gcaagcaaatgtg

SEQ ID NO: 13798 - DNA, 13 bp, Artificial Sequence
  synthetic sequence
ttaataccttgtt

SEQ ID NO: 13799 - DNA, 13 bp, Artificial Sequence
  synthetic sequence
ttatactatagcc

SEQ ID NO: 13800 - DNA, 13 bp, Artificial Sequence
  synthetic sequence
tcggtgtttaccg

SEQ ID NO: 13801 - DNA, 13 bp, Artificial Sequence
  synthetic sequence
gcgaaatgggaat

SEQ ID NO: 13802 - DNA, 13 bp, Artificial Sequence
  synthetic sequence
ttcccaacaaacg

SEQ ID NO: 13803 - DNA, 13 bp, Artificial Sequence
  synthetic sequence
ccctgctgctcag

SEQ ID NO: 13804 - DNA, 13 bp, Artificial Sequence
  synthetic sequence
ttatcgccgaacc

SEQ ID NO: 13805 - DNA, 13 bp, Artificial Sequence
  synthetic sequence
aaaagcaagtagg

SEQ ID NO: 13806 - DNA, 13 bp, Artificial Sequence
  synthetic sequence
ttcaggttcagaa

SEQ ID NO: 13807 - DNA, 13 bp, Artificial Sequence
  synthetic sequence
cattaaatgaagt

SEQ ID NO: 13808 - DNA, 13 bp, Artificial Sequence
  synthetic sequence
cttcgcctgggtg

SEQ ID NO: 13809 - DNA, 13 bp, Artificial Sequence
  synthetic sequence
ccagcataatatt

SEQ ID NO: 13810 - DNA, 13 bp, Artificial Sequence
  synthetic sequence
tggtggatgacgc

SEQ ID NO: 13811 - DNA, 13 bp, Artificial Sequence
  synthetic sequence
tcttacattaaac

SEQ ID NO: 13812 - DNA, 13 bp, Artificial Sequence
  synthetic sequence
aaattggacttcc

SEQ ID NO: 13813 - DNA, 13 bp, Artificial Sequence
  synthetic sequence
ttcgtgatcgatc

SEQ ID NO: 13814 - DNA, 13 bp, Artificial Sequence
  synthetic sequence
tcgtccaccacca

SEQ ID NO: 13815 - DNA, 13 bp, Artificial Sequence
  synthetic sequence
aaatcttcgacaa

SEQ ID NO: 13816 - DNA, 13 bp, Artificial Sequence
  synthetic sequence
aagcgcggcttct

SEQ ID NO: 13817 - DNA, 13 bp, Artificial Sequence
  synthetic sequence
acctgaccgcgct

SEQ ID NO: 13818 - DNA, 13 bp, Artificial Sequence
  synthetic sequence
tggtgccgttgtc

SEQ ID NO: 13819 - DNA, 13 bp, Artificial Sequence
  synthetic sequence
acattatccgctc

SEQ ID NO: 13820 - DNA, 13 bp, Artificial Sequence
  synthetic sequence
gaccagtccttga

SEQ ID NO: 13821 - DNA, 13 bp, Artificial Sequence
  synthetic sequence
atatggctctaat

SEQ ID NO: 13822 - DNA, 13 bp, Artificial Sequence
  synthetic sequence
acttctataagct

SEQ ID NO: 13823 - DNA, 13 bp, Artificial Sequence
  synthetic sequence
cagatcgtcatat

SEQ ID NO: 13824 - DNA, 13 bp, Artificial Sequence
  synthetic sequence
gaacaggccgatg

SEQ ID NO: 13825 - DNA, 13 bp, Artificial Sequence
  synthetic sequence
tagatgttcatgc

SEQ ID NO: 13826 - DNA, 13 bp, Artificial Sequence
  synthetic sequence
attcgcgagcaga

SEQ ID NO: 13827 - DNA, 13 bp, Artificial Sequence
  synthetic sequence
gggagtgaggtag

SEQ ID NO: 13828 - DNA, 13 bp, Artificial Sequence
  synthetic sequence
tggcgaagatgga

SEQ ID NO: 13829 - DNA, 13 bp, Artificial Sequence
  synthetic sequence
aagcgcatgagcg

SEQ ID NO: 13830 - DNA, 13 bp, Artificial Sequence
  synthetic sequence
gtacagcgaaagc

SEQ ID NO: 13831 - DNA, 13 bp, Artificial Sequence
  synthetic sequence
cgcacgaacgacg

SEQ ID NO: 13832 - DNA, 13 bp, Artificial Sequence
  synthetic sequence
cggcctgagcttc

SEQ ID NO: 13833 - DNA, 13 bp, Artificial Sequence
  synthetic sequence
caatacccatggt

SEQ ID NO: 13834 - DNA, 13 bp, Artificial Sequence
  synthetic sequence
ccatcgggatcag

SEQ ID NO: 13835 - DNA, 13 bp, Artificial Sequence
  synthetic sequence
catgtgccgctca

SEQ ID NO: 13836 - DNA, 13 bp, Artificial Sequence
  synthetic sequence
gacgatgccattg

SEQ ID NO: 13837 - DNA, 13 bp, Artificial Sequence
  synthetic sequence
gcgcacagcacca

SEQ ID NO: 13838 - DNA, 13 bp, Artificial Sequence
  synthetic sequence
tgccgctgttcct

SEQ ID NO: 13839 - DNA, 13 bp, Artificial Sequence
  synthetic sequence
ttgatctcgtcca

SEQ ID NO: 13840 - DNA, 13 bp, Artificial Sequence
  synthetic sequence
gtgctgcgcagaa

SEQ ID NO: 13841 - DNA, 13 bp, Artificial Sequence
  synthetic sequence
gtgtgatccgggt

SEQ ID NO: 13842 - DNA, 13 bp, Artificial Sequence
  synthetic sequence
gtcacttcaaaga

SEQ ID NO: 13843 - DNA, 13 bp, Artificial Sequence
  synthetic sequence
tcctgatcgatat

SEQ ID NO: 13844 - DNA, 13 bp, Artificial Sequence
  synthetic sequence
tcgtgccgatgag

SEQ ID NO: 13845 - DNA, 13 bp, Artificial Sequence
  synthetic sequence
aaaggtcaggaag

SEQ ID NO: 13846 - DNA, 13 bp, Artificial Sequence
  synthetic sequence
agaacgtccaggt

SEQ ID NO: 13847 - DNA, 13 bp, Artificial Sequence
  synthetic sequence
atttgcgcctgtt

SEQ ID NO: 13848 - DNA, 13 bp, Artificial Sequence
  synthetic sequence
tttcttatcgcgc

SEQ ID NO: 13849 - DNA, 13 bp, Artificial Sequence
  synthetic sequence
ttttaagtgcatg

SEQ ID NO: 13850 - DNA, 13 bp, Artificial Sequence
  synthetic sequence
ttactgacctgca

SEQ ID NO: 13851 - DNA, 13 bp, Artificial Sequence
  synthetic sequence
tggttttcctgct

SEQ ID NO: 13852 - DNA, 13 bp, Artificial Sequence
  synthetic sequence
gccagtagcgaga

SEQ ID NO: 13853 - DNA, 13 bp, Artificial Sequence
  synthetic sequence
ctggctggaggaa

SEQ ID NO: 13854 - DNA, 13 bp, Artificial Sequence
  synthetic sequence
aacggcgcattta

SEQ ID NO: 13855 - DNA, 13 bp, Artificial Sequence
  synthetic sequence
catttcgccaaac

SEQ ID NO: 13856 - DNA, 13 bp, Artificial Sequence
  synthetic sequence
gcagaacaaccag

SEQ ID NO: 13857 - DNA, 13 bp, Artificial Sequence
  synthetic sequence
tacaggcacagac

SEQ ID NO: 13858 - DNA, 13 bp, Artificial Sequence
  synthetic sequence
tcgtggcgtaaaa

SEQ ID NO: 13859 - DNA, 13 bp, Artificial Sequence
  synthetic sequence
atgcaacaacgac

SEQ ID NO: 13860 - DNA, 13 bp, Artificial Sequence
  synthetic sequence
tgctgctggactt

SEQ ID NO: 13861 - DNA, 13 bp, Artificial Sequence
  synthetic sequence
tcccgattgctga

SEQ ID NO: 13862 - DNA, 13 bp, Artificial Sequence
  synthetic sequence
ctattacagaaaa

SEQ ID NO: 13863 - DNA, 13 bp, Artificial Sequence
  synthetic sequence
tctaccgttccta

SEQ ID NO: 13864 - DNA, 13 bp, Artificial Sequence
  synthetic sequence
gacgtgcagaacc

SEQ ID NO: 13865 - DNA, 13 bp, Artificial Sequence
  synthetic sequence
acgatccggtgac

SEQ ID NO: 13866 - DNA, 13 bp, Artificial Sequence
  synthetic sequence
accatcgcgatac

SEQ ID NO: 13867 - DNA, 13 bp, Artificial Sequence
  synthetic sequence
gtaaagcggtcca

SEQ ID NO: 13868 - DNA, 13 bp, Artificial Sequence
  synthetic sequence
atcggcatcctgg

SEQ ID NO: 13869 - DNA, 13 bp, Artificial Sequence
  synthetic sequence
gccagatattttg

SEQ ID NO: 13870 - DNA, 13 bp, Artificial Sequence
  synthetic sequence
acaacaagatgga

SEQ ID NO: 13871 - DNA, 13 bp, Artificial Sequence
  synthetic sequence
ggaactcgttctg

SEQ ID NO: 13872 - DNA, 13 bp, Artificial Sequence
  synthetic sequence
ggcttgacagatg

SEQ ID NO: 13873 - DNA, 13 bp, Artificial Sequence
  synthetic sequence
actggcgatagat

SEQ ID NO: 13874 - DNA, 13 bp, Artificial Sequence
  synthetic sequence
attgttagctgac

SEQ ID NO: 13875 - DNA, 13 bp, Artificial Sequence
  synthetic sequence
tgaacacaaacca

SEQ ID NO: 13876 - DNA, 13 bp, Artificial Sequence
  synthetic sequence
agatctgcatcgt

SEQ ID NO: 13877 - DNA, 13 bp, Artificial Sequence
  synthetic sequence
ttgatctgggcat

SEQ ID NO: 13878 - DNA, 13 bp, Artificial Sequence
  synthetic sequence
cagggcttgagca

SEQ ID NO: 13879 - DNA, 13 bp, Artificial Sequence
  synthetic sequence
tttgtatctccaa

SEQ ID NO: 13880 - DNA, 13 bp, Artificial Sequence
  synthetic sequence
ggggctttgtagg

SEQ ID NO: 13881 - DNA, 13 bp, Artificial Sequence
  synthetic sequence
ccaaaacggaacg

SEQ ID NO: 13882 - DNA, 13 bp, Artificial Sequence
  synthetic sequence
ttatccgtgatta

SEQ ID NO: 13883 - DNA, 13 bp, Artificial Sequence
  synthetic sequence
tcagcgccggtct

SEQ ID NO: 13884 - DNA, 13 bp, Artificial Sequence
  synthetic sequence
agaaaagctgaaa

SEQ ID NO: 13885 - DNA, 13 bp, Artificial Sequence
  synthetic sequence
agcagttcggacg

SEQ ID NO: 13886 - DNA, 13 bp, Artificial Sequence
  synthetic sequence
tgctgctggcgat

SEQ ID NO: 13887 - DNA, 13 bp, Artificial Sequence
  synthetic sequence
caccgactaccgg

SEQ ID NO: 13888 - DNA, 13 bp, Artificial Sequence
  synthetic sequence
ttgatacgcttat

SEQ ID NO: 13889 - DNA, 13 bp, Artificial Sequence
  synthetic sequence
cgatcttcgcgag

SEQ ID NO: 13890 - DNA, 13 bp, Artificial Sequence
  synthetic sequence
tattctgcgccat

SEQ ID NO: 13891 - DNA, 13 bp, Artificial Sequence
  synthetic sequence
atggaggcggata

SEQ ID NO: 13892 - DNA, 13 bp, Artificial Sequence
  synthetic sequence
tatggctcagtgc

SEQ ID NO: 13893 - DNA, 13 bp, Artificial Sequence
  synthetic sequence
ttattaatgccgt

SEQ ID NO: 13894 - DNA, 13 bp, Artificial Sequence
  synthetic sequence
gtttactaggaat

SEQ ID NO: 13895 - DNA, 13 bp, Artificial Sequence
  synthetic sequence
ccagagaataaca

SEQ ID NO: 13896 - DNA, 13 bp, Artificial Sequence
  synthetic sequence
gtcctcgggcttg

SEQ ID NO: 13897 - DNA, 13 bp, Artificial Sequence
  synthetic sequence
atgagcgataaaa

SEQ ID NO: 13898 - DNA, 13 bp, Artificial Sequence
  synthetic sequence
taccgtgcgattg

SEQ ID NO: 13899 - DNA, 13 bp, Artificial Sequence
  synthetic sequence
gcacctcgatatg

SEQ ID NO: 13900 - DNA, 13 bp, Artificial Sequence
  synthetic sequence
gctgctctttgtt

SEQ ID NO: 13901 - DNA, 13 bp, Artificial Sequence
  synthetic sequence
gcagcggccatta

SEQ ID NO: 13902 - DNA, 13 bp, Artificial Sequence
  synthetic sequence
ccggcggtggtat

SEQ ID NO: 13903 - DNA, 13 bp, Artificial Sequence
  synthetic sequence
cagaaaatcctga

SEQ ID NO: 13904 - DNA, 13 bp, Artificial Sequence
  synthetic sequence
caggtgcagaata

SEQ ID NO: 13905 - DNA, 13 bp, Artificial Sequence
  synthetic sequence
gcgtcttgaaaac

SEQ ID NO: 13906 - DNA, 13 bp, Artificial Sequence
  synthetic sequence
tctatgccgttat

SEQ ID NO: 13907 - DNA, 13 bp, Artificial Sequence
  synthetic sequence
cgtcaccggaact

SEQ ID NO: 13908 - DNA, 13 bp, Artificial Sequence
  synthetic sequence
aagcgggtggaag

SEQ ID NO: 13909 - DNA, 13 bp, Artificial Sequence
  synthetic sequence
gccctgctgatcg

SEQ ID NO: 13910 - DNA, 13 bp, Artificial Sequence
  synthetic sequence
ggttaagcttatc

SEQ ID NO: 13911 - DNA, 13 bp, Artificial Sequence
  synthetic sequence
tatgtacttttgc

SEQ ID NO: 13912 - DNA, 13 bp, Artificial Sequence
  synthetic sequence
aacaattctgttc

SEQ ID NO: 13913 - DNA, 13 bp, Artificial Sequence
  synthetic sequence
ccgaaccttatct

SEQ ID NO: 13914 - DNA, 13 bp, Artificial Sequence
  synthetic sequence
aaatcaatcccct

SEQ ID NO: 13915 - DNA, 13 bp, Artificial Sequence
  synthetic sequence
catttattaggct

SEQ ID NO: 13916 - DNA, 13 bp, Artificial Sequence
  synthetic sequence
tacgcgagatgat

SEQ ID NO: 13917 - DNA, 13 bp, Artificial Sequence
  synthetic sequence
gaaacgtcttgct

SEQ ID NO: 13918 - DNA, 13 bp, Artificial Sequence
  synthetic sequence
ggtctgcttgagc

SEQ ID NO: 13919 - DNA, 13 bp, Artificial Sequence
  synthetic sequence
accagcacgacca

SEQ ID NO: 13920 - DNA, 13 bp, Artificial Sequence
  synthetic sequence
ctgacgataggtc

SEQ ID NO: 13921 - DNA, 13 bp, Artificial Sequence
  synthetic sequence
ctgaaataaacag

SEQ ID NO: 13922 - DNA, 13 bp, Artificial Sequence
  synthetic sequence
gatacattcgtcc

SEQ ID NO: 13923 - DNA, 13 bp, Artificial Sequence
  synthetic sequence
cttattgaggctt

SEQ ID NO: 13924 - DNA, 13 bp, Artificial Sequence
  synthetic sequence
tcgacgcgatcgc

SEQ ID NO: 13925 - DNA, 13 bp, Artificial Sequence
  synthetic sequence
agcctagggttgc

SEQ ID NO: 13926 - DNA, 13 bp, Artificial Sequence
  synthetic sequence
gcgtgttttcggc

SEQ ID NO: 13927 - DNA, 13 bp, Artificial Sequence
  synthetic sequence
gatttgttatctt

SEQ ID NO: 13928 - DNA, 13 bp, Artificial Sequence
  synthetic sequence
gaaattcttgcaa

SEQ ID NO: 13929 - DNA, 13 bp, Artificial Sequence
  synthetic sequence
gagcggcgcaata

SEQ ID NO: 13930 - DNA, 13 bp, Artificial Sequence
  synthetic sequence
cgttgccgtgctt

SEQ ID NO: 13931 - DNA, 13 bp, Artificial Sequence
  synthetic sequence
taccaatacgacc

SEQ ID NO: 13932 - DNA, 13 bp, Artificial Sequence
  synthetic sequence
acctaaatttatc

SEQ ID NO: 13933 - DNA, 13 bp, Artificial Sequence
  synthetic sequence
ctttccggccacc

SEQ ID NO: 13934 - DNA, 13 bp, Artificial Sequence
  synthetic sequence
ttttgctcgcccg

SEQ ID NO: 13935 - DNA, 13 bp, Artificial Sequence
  synthetic sequence
cagtactttaaaa

SEQ ID NO: 13936 - DNA, 13 bp, Artificial Sequence
  synthetic sequence
gcattgatgtact

SEQ ID NO: 13937 - DNA, 13 bp, Artificial Sequence
  synthetic sequence
aatttacgacaca

SEQ ID NO: 13938 - DNA, 13 bp, Artificial Sequence
  synthetic sequence
cgcagtggatggc

SEQ ID NO: 13939 - DNA, 13 bp, Artificial Sequence
  synthetic sequence
gcaccggcaatcg

SEQ ID NO: 13940 - DNA, 13 bp, Artificial Sequence
  synthetic sequence
tcgatgcacggct

SEQ ID NO: 13941 - DNA, 13 bp, Artificial Sequence
  synthetic sequence
cgtagatcagcag

SEQ ID NO: 13942 - DNA, 13 bp, Artificial Sequence
  synthetic sequence
tattagatgccat

SEQ ID NO: 13943 - DNA, 13 bp, Artificial Sequence
  synthetic sequence
cagcacaggcaag

SEQ ID NO: 13944 - DNA, 13 bp, Artificial Sequence
  synthetic sequence
atgagtggctaaa

SEQ ID NO: 13945 - DNA, 13 bp, Artificial Sequence
  synthetic sequence
ttggccagcagtt

SEQ ID NO: 13946 - DNA, 13 bp, Artificial Sequence
  synthetic sequence
gccaggatttctc

SEQ ID NO: 13947 - DNA, 13 bp, Artificial Sequence
  synthetic sequence
ccggtattaccct

SEQ ID NO: 13948 - DNA, 13 bp, Artificial Sequence
  synthetic sequence
tcaatattggaat

SEQ ID NO: 13949 - DNA, 13 bp, Artificial Sequence
  synthetic sequence
cgacctgacccag

SEQ ID NO: 13950 - DNA, 13 bp, Artificial Sequence
  synthetic sequence
caaaaggatacgt

SEQ ID NO: 13951 - DNA, 13 bp, Artificial Sequence
  synthetic sequence
caatgagtgtcat

SEQ ID NO: 13952 - DNA, 13 bp, Artificial Sequence
  synthetic sequence
tgtgggttgtcgc

SEQ ID NO: 13953 - DNA, 13 bp, Artificial Sequence
  synthetic sequence
ctagtatcccaag

SEQ ID NO: 13954 - DNA, 13 bp, Artificial Sequence
  synthetic sequence
gccgcgtttctcg

SEQ ID NO: 13955 - DNA, 13 bp, Artificial Sequence
  synthetic sequence
gagaacatagcgt

SEQ ID NO: 13956 - DNA, 13 bp, Artificial Sequence
  synthetic sequence
tggcagattggtt

SEQ ID NO: 13957 - DNA, 13 bp, Artificial Sequence
  synthetic sequence
catggagaacgac

SEQ ID NO: 13958 - DNA, 13 bp, Artificial Sequence
  synthetic sequence
caatgtatgtaaa

SEQ ID NO: 13959 - DNA, 13 bp, Artificial Sequence
  synthetic sequence
ctcgtcaagcagg

SEQ ID NO: 13960 - DNA, 13 bp, Artificial Sequence
  synthetic sequence
atcaacggcgcaa

SEQ ID NO: 13961 - DNA, 13 bp, Artificial Sequence
  synthetic sequence
tgtcgaggatgat

SEQ ID NO: 13962 - DNA, 13 bp, Artificial Sequence
  synthetic sequence
taccggtgcgact

SEQ ID NO: 13963 - DNA, 13 bp, Artificial Sequence
  synthetic sequence
ttaggttgggatc

SEQ ID NO: 13964 - DNA, 13 bp, Artificial Sequence
  synthetic sequence
tcgcccttcttca

SEQ ID NO: 13965 - DNA, 13 bp, Artificial Sequence
  synthetic sequence
ctttgatgattgt

SEQ ID NO: 13966 - DNA, 13 bp, Artificial Sequence
  synthetic sequence
ggcaaaattaatc

SEQ ID NO: 13967 - DNA, 13 bp, Artificial Sequence
  synthetic sequence
tcagtgaggcacc

SEQ ID NO: 13968 - DNA, 13 bp, Artificial Sequence
  synthetic sequence
tttcctcagccgt

SEQ ID NO: 13969 - DNA, 13 bp, Artificial Sequence
  synthetic sequence
tcgatatcaaagt

SEQ ID NO: 13970 - DNA, 13 bp, Artificial Sequence
  synthetic sequence
agtactcaccagt

SEQ ID NO: 13971 - DNA, 13 bp, Artificial Sequence
  synthetic sequence
tctttatagatcg

SEQ ID NO: 13972 - DNA, 13 bp, Artificial Sequence
  synthetic sequence
gatcaggccgatc

SEQ ID NO: 13973 - DNA, 13 bp, Artificial Sequence
  synthetic sequence
tgaaaatgaggat

SEQ ID NO: 13974 - DNA, 13 bp, Artificial Sequence
  synthetic sequence
cagtcgtacgttg

SEQ ID NO: 13975 - DNA, 13 bp, Artificial Sequence
  synthetic sequence
aaggaccgcttct

SEQ ID NO: 13976 - DNA, 13 bp, Artificial Sequence
  synthetic sequence
cgatagatggcaa

SEQ ID NO: 13977 - DNA, 13 bp, Artificial Sequence
  synthetic sequence
gtttactaaacgg

SEQ ID NO: 13978 - DNA, 13 bp, Artificial Sequence
  synthetic sequence
tccgatcagatgc

SEQ ID NO: 13979 - DNA, 13 bp, Artificial Sequence
  synthetic sequence
gtagccctcaagt

SEQ ID NO: 13980 - DNA, 13 bp, Artificial Sequence
  synthetic sequence
tttgccgaactct

SEQ ID NO: 13981 - DNA, 13 bp, Artificial Sequence
  synthetic sequence
agcaactggtgca

SEQ ID NO: 13982 - DNA, 13 bp, Artificial Sequence
  synthetic sequence
aaaccgagagaaa

SEQ ID NO: 13983 - DNA, 13 bp, Artificial Sequence
  synthetic sequence
tatgacccgaatg

SEQ ID NO: 13984 - DNA, 13 bp, Artificial Sequence
  synthetic sequence
caaaatggcatgg

SEQ ID NO: 13985 - DNA, 13 bp, Artificial Sequence
  synthetic sequence
attattccaaact

SEQ ID NO: 13986 - DNA, 13 bp, Artificial Sequence
  synthetic sequence
acatcagccgcgg

SEQ ID NO: 13987 - DNA, 13 bp, Artificial Sequence
  synthetic sequence
cgatcgcagcttc

SEQ ID NO: 13988 - DNA, 13 bp, Artificial Sequence
  synthetic sequence
tgggattggtatt

SEQ ID NO: 13989 - DNA, 13 bp, Artificial Sequence
  synthetic sequence
ctatgcgctttaa

SEQ ID NO: 13990 - DNA, 13 bp, Artificial Sequence
  synthetic sequence
atttaggtgtggg

SEQ ID NO: 13991 - DNA, 13 bp, Artificial Sequence
  synthetic sequence
tggccggcatcac

SEQ ID NO: 13992 - DNA, 13 bp, Artificial Sequence
  synthetic sequence
cagaataaaggcg

SEQ ID NO: 13993 - DNA, 13 bp, Artificial Sequence
  synthetic sequence
cttctacctgcag

SEQ ID NO: 13994 - DNA, 13 bp, Artificial Sequence
  synthetic sequence
ttttcacgaacgg

SEQ ID NO: 13995 - DNA, 13 bp, Artificial Sequence
  synthetic sequence
tgcgccatcacgc

SEQ ID NO: 13996 - DNA, 13 bp, Artificial Sequence
  synthetic sequence
acgttgggatgac

SEQ ID NO: 13997 - DNA, 13 bp, Artificial Sequence
  synthetic sequence
tctccctgttagc

SEQ ID NO: 13998 - DNA, 13 bp, Artificial Sequence
  synthetic sequence
ctgaaaacagcca

SEQ ID NO: 13999 - DNA, 13 bp, Artificial Sequence
  synthetic sequence
atgtggcctcaca

SEQ ID NO: 14000 - DNA, 13 bp, Artificial Sequence
  synthetic sequence
cgccagcacggta

SEQ ID NO: 14001 - DNA, 13 bp, Artificial Sequence
  synthetic sequence
acttcagcatggt

SEQ ID NO: 14002 - DNA, 13 bp, Artificial Sequence
  synthetic sequence
aaagaagatggta

SEQ ID NO: 14003 - DNA, 13 bp, Artificial Sequence
  synthetic sequence
gatttcatcattt

SEQ ID NO: 14004 - DNA, 13 bp, Artificial Sequence
  synthetic sequence
ttgcgagggtaaa

SEQ ID NO: 14005 - DNA, 13 bp, Artificial Sequence
  synthetic sequence
cgggcttgtcgaa

SEQ ID NO: 14006 - DNA, 13 bp, Artificial Sequence
  synthetic sequence
accgacgtggtca

SEQ ID NO: 14007 - DNA, 13 bp, Artificial Sequence
  synthetic sequence
accggagctgtag

SEQ ID NO: 14008 - DNA, 13 bp, Artificial Sequence
  synthetic sequence
ggaaggataatct

SEQ ID NO: 14009 - DNA, 13 bp, Artificial Sequence
  synthetic sequence
cgctggatgcgca

SEQ ID NO: 14010 - DNA, 13 bp, Artificial Sequence
  synthetic sequence
gtattgcgccatg

SEQ ID NO: 14011 - DNA, 13 bp, Artificial Sequence
  synthetic sequence
ctctcgctggatt

SEQ ID NO: 14012 - DNA, 13 bp, Artificial Sequence
  synthetic sequence
atcgcctgcacct

SEQ ID NO: 14013 - DNA, 13 bp, Artificial Sequence
  synthetic sequence
tccgcatttatct

SEQ ID NO: 14014 - DNA, 13 bp, Artificial Sequence
  synthetic sequence
aagtatcatgtgg

SEQ ID NO: 14015 - DNA, 13 bp, Artificial Sequence
  synthetic sequence
accgcttgcggct

SEQ ID NO: 14016 - DNA, 13 bp, Artificial Sequence
  synthetic sequence
acgatacgtcata

SEQ ID NO: 14017 - DNA, 13 bp, Artificial Sequence
  synthetic sequence
ttatcacacatca

SEQ ID NO: 14018 - DNA, 13 bp, Artificial Sequence
  synthetic sequence
tacatcgaactgg

SEQ ID NO: 14019 - DNA, 13 bp, Artificial Sequence
  synthetic sequence
ctgaatttgctta

SEQ ID NO: 14020 - DNA, 13 bp, Artificial Sequence
  synthetic sequence
tgcccttcaccgc

SEQ ID NO: 14021 - DNA, 13 bp, Artificial Sequence
  synthetic sequence
tcctgttcaggaa

SEQ ID NO: 14022 - DNA, 13 bp, Artificial Sequence
  synthetic sequence
gatcacgaaaggg

SEQ ID NO: 14023 - DNA, 13 bp, Artificial Sequence
  synthetic sequence
atgctggcgcacg

SEQ ID NO: 14024 - DNA, 13 bp, Artificial Sequence
  synthetic sequence
ttaagaaatccaa

SEQ ID NO: 14025 - DNA, 13 bp, Artificial Sequence
  synthetic sequence
agtatatcgcagg

SEQ ID NO: 14026 - DNA, 13 bp, Artificial Sequence
  synthetic sequence
atcggcttcggcg

SEQ ID NO: 14027 - DNA, 13 bp, Artificial Sequence
  synthetic sequence
agctatccttccg

SEQ ID NO: 14028 - DNA, 13 bp, Artificial Sequence
  synthetic sequence
atcacttgggatg

SEQ ID NO: 14029 - DNA, 13 bp, Artificial Sequence
  synthetic sequence
actcgctcgcgat

SEQ ID NO: 14030 - DNA, 13 bp, Artificial Sequence
  synthetic sequence
catttccgccatg

SEQ ID NO: 14031 - DNA, 13 bp, Artificial Sequence
  synthetic sequence
acgttcagaccaa

SEQ ID NO: 14032 - DNA, 13 bp, Artificial Sequence
  synthetic sequence
cgaacagaccgat

SEQ ID NO: 14033 - DNA, 13 bp, Artificial Sequence
  synthetic sequence
aaaccggctaatg

SEQ ID NO: 14034 - DNA, 13 bp, Artificial Sequence
  synthetic sequence
tgatctcgccttt

SEQ ID NO: 14035 - DNA, 13 bp, Artificial Sequence
  synthetic sequence
cgaccgcctgttc

SEQ ID NO: 14036 - DNA, 13 bp, Artificial Sequence
  synthetic sequence
atgattggcttaa

SEQ ID NO: 14037 - DNA, 13 bp, Artificial Sequence
  synthetic sequence
aaagatggcaaag

SEQ ID NO: 14038 - DNA, 13 bp, Artificial Sequence
  synthetic sequence
agcgcctgggtct

SEQ ID NO: 14039 - DNA, 13 bp, Artificial Sequence
  synthetic sequence
tcatcatgccggt

SEQ ID NO: 14040 - DNA, 13 bp, Artificial Sequence
  synthetic sequence
tttcttcggcgcc

SEQ ID NO: 14041 - DNA, 13 bp, Artificial Sequence
  synthetic sequence
ataacttgcacaa

SEQ ID NO: 14042 - DNA, 13 bp, Artificial Sequence
  synthetic sequence
caggttacggaca

SEQ ID NO: 14043 - DNA, 13 bp, Artificial Sequence
  synthetic sequence
tcccgatggggag

SEQ ID NO: 14044 - DNA, 13 bp, Artificial Sequence
  synthetic sequence
gctggaagctcta

SEQ ID NO: 14045 - DNA, 13 bp, Artificial Sequence
  synthetic sequence
gcgccaaaggcga

SEQ ID NO: 14046 - DNA, 13 bp, Artificial Sequence
  synthetic sequence
gctgtatgcggag

SEQ ID NO: 14047 - DNA, 13 bp, Artificial Sequence
  synthetic sequence
ccttattttaccc

SEQ ID NO: 14048 - DNA, 13 bp, Artificial Sequence
  synthetic sequence
tggtttgttctga

SEQ ID NO: 14049 - DNA, 13 bp, Artificial Sequence
  synthetic sequence
ccgccgtagacca

SEQ ID NO: 14050 - DNA, 13 bp, Artificial Sequence
  synthetic sequence
ttgccagagtgaa

SEQ ID NO: 14051 - DNA, 13 bp, Artificial Sequence
  synthetic sequence
ggtaaacagcgtg

SEQ ID NO: 14052 - DNA, 13 bp, Artificial Sequence
  synthetic sequence
gcattattcagtt

SEQ ID NO: 14053 - DNA, 13 bp, Artificial Sequence
  synthetic sequence
cgctgcgcgtatt

SEQ ID NO: 14054 - DNA, 13 bp, Artificial Sequence
  synthetic sequence
agatggaggtgct

SEQ ID NO: 14055 - DNA, 13 bp, Artificial Sequence
  synthetic sequence
ggcctgaattgac

SEQ ID NO: 14056 - DNA, 13 bp, Artificial Sequence
  synthetic sequence
ccttgtatgatcc

SEQ ID NO: 14057 - DNA, 13 bp, Artificial Sequence
  synthetic sequence
atgaccgatcgtt

SEQ ID NO: 14058 - DNA, 13 bp, Artificial Sequence
  synthetic sequence
gtagttttgccct

SEQ ID NO: 14059 - DNA, 13 bp, Artificial Sequence
  synthetic sequence
acaataaagcggt

SEQ ID NO: 14060 - DNA, 13 bp, Artificial Sequence
  synthetic sequence
ccgaaaccggcca

SEQ ID NO: 14061 - DNA, 13 bp, Artificial Sequence
  synthetic sequence
tccggcatccagc

SEQ ID NO: 14062 - DNA, 13 bp, Artificial Sequence
  synthetic sequence
tgaatgccaaggc

SEQ ID NO: 14063 - DNA, 13 bp, Artificial Sequence
  synthetic sequence
aactgcatcgcta

SEQ ID NO: 14064 - DNA, 13 bp, Artificial Sequence
  synthetic sequence
ggcttgcgcttga

SEQ ID NO: 14065 - DNA, 13 bp, Artificial Sequence
  synthetic sequence
ctgaacatatggc

SEQ ID NO: 14066 - DNA, 13 bp, Artificial Sequence
  synthetic sequence
atttctcacgcca

SEQ ID NO: 14067 - DNA, 13 bp, Artificial Sequence
  synthetic sequence
catcggcattacc

SEQ ID NO: 14068 - DNA, 13 bp, Artificial Sequence
  synthetic sequence
cagatgctacgtg

SEQ ID NO: 14069 - DNA, 13 bp, Artificial Sequence
  synthetic sequence
atgtcggagctgg

SEQ ID NO: 14070 - DNA, 13 bp, Artificial Sequence
  synthetic sequence
ttgtgaacattgt

SEQ ID NO: 14071 - DNA, 13 bp, Artificial Sequence
  synthetic sequence
tttgctcttgaag

SEQ ID NO: 14072 - DNA, 13 bp, Artificial Sequence
  synthetic sequence
actggctgacgcg

SEQ ID NO: 14073 - DNA, 13 bp, Artificial Sequence
  synthetic sequence
tatttgctattac

SEQ ID NO: 14074 - DNA, 13 bp, Artificial Sequence
  synthetic sequence
atgcactcgctgc

SEQ ID NO: 14075 - DNA, 13 bp, Artificial Sequence
  synthetic sequence
cgaagggcgttgt

SEQ ID NO: 14076 - DNA, 13 bp, Artificial Sequence
  synthetic sequence
aaaggttttcatt

SEQ ID NO: 14077 - DNA, 13 bp, Artificial Sequence
  synthetic sequence
ataccgcgcaggt

SEQ ID NO: 14078 - DNA, 13 bp, Artificial Sequence
  synthetic sequence
tgttccatgaata

SEQ ID NO: 14079 - DNA, 13 bp, Artificial Sequence
  synthetic sequence
cggtaaatcgcaa

SEQ ID NO: 14080 - DNA, 13 bp, Artificial Sequence
  synthetic sequence
tgttcatcaccga

SEQ ID NO: 14081 - DNA, 13 bp, Artificial Sequence
  synthetic sequence
gggtgtggtcggt

SEQ ID NO: 14082 - DNA, 13 bp, Artificial Sequence
  synthetic sequence
gtcccttcaaagg

SEQ ID NO: 14083 - DNA, 13 bp, Artificial Sequence
  synthetic sequence
tgaaaacggctga

SEQ ID NO: 14084 - DNA, 13 bp, Artificial Sequence
  synthetic sequence
cggggatccacat

SEQ ID NO: 14085 - DNA, 13 bp, Artificial Sequence
  synthetic sequence
ctgaggatggcgt

SEQ ID NO: 14086 - DNA, 13 bp, Artificial Sequence
  synthetic sequence
caaaggccatcgg

SEQ ID NO: 14087 - DNA, 13 bp, Artificial Sequence
  synthetic sequence
cggtttctcttcc

SEQ ID NO: 14088 - DNA, 13 bp, Artificial Sequence
  synthetic sequence
atcggcctgaact

SEQ ID NO: 14089 - DNA, 13 bp, Artificial Sequence
  synthetic sequence
gaggaagttgtac

SEQ ID NO: 14090 - DNA, 13 bp, Artificial Sequence
  synthetic sequence
tgaaagtatcatt

SEQ ID NO: 14091 - DNA, 13 bp, Artificial Sequence
  synthetic sequence
ctgactaaactgc

SEQ ID NO: 14092 - DNA, 13 bp, Artificial Sequence
  synthetic sequence
ttataaaagctgt

SEQ ID NO: 14093 - DNA, 13 bp, Artificial Sequence
  synthetic sequence
accacacctatgt

SEQ ID NO: 14094 - DNA, 13 bp, Artificial Sequence
  synthetic sequence
atcaagtcagcca

SEQ ID NO: 14095 - DNA, 13 bp, Artificial Sequence
  synthetic sequence
cgcctgcgctttt

SEQ ID NO: 14096 - DNA, 13 bp, Artificial Sequence
  synthetic sequence
cgaaagcccaggc

SEQ ID NO: 14097 - DNA, 13 bp, Artificial Sequence
  synthetic sequence
gaacaagaggaaa

SEQ ID NO: 14098 - DNA, 13 bp, Artificial Sequence
  synthetic sequence
atcagtcacgcgt

SEQ ID NO: 14099 - DNA, 13 bp, Artificial Sequence
  synthetic sequence
ctggtgagcatgg

SEQ ID NO: 14100 - DNA, 13 bp, Artificial Sequence
  synthetic sequence
gaagcccagctgc

SEQ ID NO: 14101 - DNA, 13 bp, Artificial Sequence
  synthetic sequence
ttctcgcggtcga

SEQ ID NO: 14102 - DNA, 13 bp, Artificial Sequence
  synthetic sequence
tgatcgagcgcgc

SEQ ID NO: 14103 - DNA, 13 bp, Artificial Sequence
  synthetic sequence
acggcggacaaca

SEQ ID NO: 14104 - DNA, 13 bp, Artificial Sequence
  synthetic sequence
cttcaatgcctgt

SEQ ID NO: 14105 - DNA, 13 bp, Artificial Sequence
  synthetic sequence
aacagatccctgt

SEQ ID NO: 14106 - DNA, 13 bp, Artificial Sequence
  synthetic sequence
tcacgctcgtcgt

SEQ ID NO: 14107 - DNA, 13 bp, Artificial Sequence
  synthetic sequence
aaacattagacga

SEQ ID NO: 14108 - DNA, 13 bp, Artificial Sequence
  synthetic sequence
agcgcctggacga

SEQ ID NO: 14109 - DNA, 13 bp, Artificial Sequence
  synthetic sequence
cagtacaacttcc

SEQ ID NO: 14110 - DNA, 13 bp, Artificial Sequence
  synthetic sequence
tttgctgccgctg

SEQ ID NO: 14111 - DNA, 13 bp, Artificial Sequence
  synthetic sequence
ggcatcgccagca

SEQ ID NO: 14112 - DNA, 13 bp, Artificial Sequence
  synthetic sequence
tgaagccgttgat

SEQ ID NO: 14113 - DNA, 13 bp, Artificial Sequence
  synthetic sequence
gtacaagcacaaa

SEQ ID NO: 14114 - DNA, 13 bp, Artificial Sequence
  synthetic sequence
gaaaagagtattt

SEQ ID NO: 14115 - DNA, 13 bp, Artificial Sequence
  synthetic sequence
tactgggtgatgt

SEQ ID NO: 14116 - DNA, 13 bp, Artificial Sequence
  synthetic sequence
tgtcgttctgtcc

SEQ ID NO: 14117 - DNA, 13 bp, Artificial Sequence
  synthetic sequence
attcttgcggcta

SEQ ID NO: 14118 - DNA, 13 bp, Artificial Sequence
  synthetic sequence
aatccttgcgcgc

SEQ ID NO: 14119 - DNA, 13 bp, Artificial Sequence
  synthetic sequence
cgatgggcatcat

SEQ ID NO: 14120 - DNA, 13 bp, Artificial Sequence
  synthetic sequence
atggcgtaatcgg

SEQ ID NO: 14121 - DNA, 13 bp, Artificial Sequence
  synthetic sequence
ataattcccatat

SEQ ID NO: 14122 - DNA, 13 bp, Artificial Sequence
  synthetic sequence
tggccgaactcaa

SEQ ID NO: 14123 - DNA, 13 bp, Artificial Sequence
  synthetic sequence
agcaaaagtacat

SEQ ID NO: 14124 - DNA, 13 bp, Artificial Sequence
  synthetic sequence
aatcctttagaag

SEQ ID NO: 14125 - DNA, 13 bp, Artificial Sequence
  synthetic sequence
tgcgccgcacttc

SEQ ID NO: 14126 - DNA, 13 bp, Artificial Sequence
  synthetic sequence
ggcggtggatgtt

SEQ ID NO: 14127 - DNA, 13 bp, Artificial Sequence
  synthetic sequence
tggttggcgtgcg

SEQ ID NO: 14128 - DNA, 13 bp, Artificial Sequence
  synthetic sequence
acgatcggcccag

SEQ ID NO: 14129 - DNA, 13 bp, Artificial Sequence
  synthetic sequence
agtcgtgccgcat

SEQ ID NO: 14130 - DNA, 13 bp, Artificial Sequence
  synthetic sequence
gtcattggcaatg

SEQ ID NO: 14131 - DNA, 13 bp, Artificial Sequence
  synthetic sequence
ttggaataaacgc

SEQ ID NO: 14132 - DNA, 13 bp, Artificial Sequence
  synthetic sequence
tagaaagccatac

SEQ ID NO: 14133 - DNA, 13 bp, Artificial Sequence
  synthetic sequence
gcgaccgaaattg

SEQ ID NO: 14134 - DNA, 13 bp, Artificial Sequence
  synthetic sequence
ggtactttgcagg

SEQ ID NO: 14135 - DNA, 13 bp, Artificial Sequence
  synthetic sequence
tgtggaacgccgg

SEQ ID NO: 14136 - DNA, 13 bp, Artificial Sequence
  synthetic sequence
acgtactgaccct

SEQ ID NO: 14137 - DNA, 13 bp, Artificial Sequence
  synthetic sequence
cgctgttgctgtt

SEQ ID NO: 14138 - DNA, 13 bp, Artificial Sequence
  synthetic sequence
caccacgtctgga

SEQ ID NO: 14139 - DNA, 13 bp, Artificial Sequence
  synthetic sequence
catcagcgcctgc

SEQ ID NO: 14140 - DNA, 13 bp, Artificial Sequence
  synthetic sequence
gcttgtggtggca

SEQ ID NO: 14141 - DNA, 13 bp, Artificial Sequence
  synthetic sequence
cgctcgacgttct

SEQ ID NO: 14142 - DNA, 13 bp, Artificial Sequence
  synthetic sequence
cttcttcagtcag

SEQ ID NO: 14143 - DNA, 13 bp, Artificial Sequence
  synthetic sequence
tacagaacaacca

SEQ ID NO: 14144 - DNA, 13 bp, Artificial Sequence
  synthetic sequence
ttgaaaccgttga

SEQ ID NO: 14145 - DNA, 13 bp, Artificial Sequence
  synthetic sequence
tgtctgaaacctc

SEQ ID NO: 14146 - DNA, 13 bp, Artificial Sequence
  synthetic sequence
atttattcaagga

SEQ ID NO: 14147 - DNA, 13 bp, Artificial Sequence
  synthetic sequence
ctattgctaatga

SEQ ID NO: 14148 - DNA, 13 bp, Artificial Sequence
  synthetic sequence
gtcagctcctgct

SEQ ID NO: 14149 - DNA, 13 bp, Artificial Sequence
  synthetic sequence
ataaagataatgg

SEQ ID NO: 14150 - DNA, 13 bp, Artificial Sequence
  synthetic sequence
acataccatcagt

SEQ ID NO: 14151 - DNA, 13 bp, Artificial Sequence
  synthetic sequence
acggcagcgcaaa

SEQ ID NO: 14152 - DNA, 13 bp, Artificial Sequence
  synthetic sequence
tccagaaaatcca

SEQ ID NO: 14153 - DNA, 13 bp, Artificial Sequence
  synthetic sequence
atctttggtaaat

SEQ ID NO: 14154 - DNA, 13 bp, Artificial Sequence
  synthetic sequence
cgtttcataaaga

SEQ ID NO: 14155 - DNA, 13 bp, Artificial Sequence
  synthetic sequence
catgaccaggcac

SEQ ID NO: 14156 - DNA, 13 bp, Artificial Sequence
  synthetic sequence
caaaatatctggc

SEQ ID NO: 14157 - DNA, 13 bp, Artificial Sequence
  synthetic sequence
atcggcaatctgc

SEQ ID NO: 14158 - DNA, 13 bp, Artificial Sequence
  synthetic sequence
aggagctaaccgc

SEQ ID NO: 14159 - DNA, 13 bp, Artificial Sequence
  synthetic sequence
gacatatcccaag

SEQ ID NO: 14160 - DNA, 13 bp, Artificial Sequence
  synthetic sequence
ttgatgttggtat

SEQ ID NO: 14161 - DNA, 13 bp, Artificial Sequence
  synthetic sequence
gcagaacgtgcag

SEQ ID NO: 14162 - DNA, 13 bp, Artificial Sequence
  synthetic sequence
agaaggccgcgca

SEQ ID NO: 14163 - DNA, 13 bp, Artificial Sequence
  synthetic sequence
aggatgtttatac

SEQ ID NO: 14164 - DNA, 13 bp, Artificial Sequence
  synthetic sequence
cagcaccatcgcc

SEQ ID NO: 14165 - DNA, 13 bp, Artificial Sequence
  synthetic sequence
cgtaccgaccgag

SEQ ID NO: 14166 - DNA, 13 bp, Artificial Sequence
  synthetic sequence
tttaagtgatttc

SEQ ID NO: 14167 - DNA, 13 bp, Artificial Sequence
  synthetic sequence
tataattgtcatg

SEQ ID NO: 14168 - DNA, 13 bp, Artificial Sequence
  synthetic sequence
gggtcatgtttgc

SEQ ID NO: 14169 - DNA, 13 bp, Artificial Sequence
  synthetic sequence
tggcgcgctgtta

SEQ ID NO: 14170 - DNA, 13 bp, Artificial Sequence
  synthetic sequence
tatggttcgccac

SEQ ID NO: 14171 - DNA, 13 bp, Artificial Sequence
  synthetic sequence
accgctgccgcta

SEQ ID NO: 14172 - DNA, 13 bp, Artificial Sequence
  synthetic sequence
ggagcacgcgttg

SEQ ID NO: 14173 - DNA, 13 bp, Artificial Sequence
  synthetic sequence
atgatggaaggcc

SEQ ID NO: 14174 - DNA, 13 bp, Artificial Sequence
  synthetic sequence
gttgatgtcggcc

SEQ ID NO: 14175 - DNA, 13 bp, Artificial Sequence
  synthetic sequence
ccgtcttcagccg

SEQ ID NO: 14176 - DNA, 13 bp, Artificial Sequence
  synthetic sequence
tttctttgctagt

SEQ ID NO: 14177 - DNA, 13 bp, Artificial Sequence
  synthetic sequence
tgctggccatggt

SEQ ID NO: 14178 - DNA, 13 bp, Artificial Sequence
  synthetic sequence
aatgcaacaatag

SEQ ID NO: 14179 - DNA, 13 bp, Artificial Sequence
  synthetic sequence
cagctgtttccca

SEQ ID NO: 14180 - DNA, 13 bp, Artificial Sequence
  synthetic sequence
agcgtcacgccga

SEQ ID NO: 14181 - DNA, 13 bp, Artificial Sequence
  synthetic sequence
gaccttcgcactg

SEQ ID NO: 14182 - DNA, 13 bp, Artificial Sequence
  synthetic sequence
gacgttgcaggaa

SEQ ID NO: 14183 - DNA, 13 bp, Artificial Sequence
  synthetic sequence
agcagtttctcga

SEQ ID NO: 14184 - DNA, 13 bp, Artificial Sequence
  synthetic sequence
tgctgccgaacat

SEQ ID NO: 14185 - DNA, 13 bp, Artificial Sequence
  synthetic sequence
gcttctttcggcg

SEQ ID NO: 14186 - DNA, 13 bp, Artificial Sequence
  synthetic sequence
tgctggtgggcgt

SEQ ID NO: 14187 - DNA, 13 bp, Artificial Sequence
  synthetic sequence
gtactcttgcctg

SEQ ID NO: 14188 - DNA, 13 bp, Artificial Sequence
  synthetic sequence
tgctcgatctggc

SEQ ID NO: 14189 - DNA, 13 bp, Artificial Sequence
  synthetic sequence
ggcgcagaacatc

SEQ ID NO: 14190 - DNA, 13 bp, Artificial Sequence
  synthetic sequence
acgccctgttcgc

SEQ ID NO: 14191 - DNA, 13 bp, Artificial Sequence
  synthetic sequence
acctggaagaaca

SEQ ID NO: 14192 - DNA, 13 bp, Artificial Sequence
  synthetic sequence
catacatggatta

SEQ ID NO: 14193 - DNA, 13 bp, Artificial Sequence
  synthetic sequence
tggagtccgatta

SEQ ID NO: 14194 - DNA, 13 bp, Artificial Sequence
  synthetic sequence
taattgtaccaat

SEQ ID NO: 14195 - DNA, 13 bp, Artificial Sequence
  synthetic sequence
cacaatggccatg

SEQ ID NO: 14196 - DNA, 13 bp, Artificial Sequence
  synthetic sequence
aatccatgttttg

SEQ ID NO: 14197 - DNA, 13 bp, Artificial Sequence
  synthetic sequence
accatggccaagg

SEQ ID NO: 14198 - DNA, 13 bp, Artificial Sequence
  synthetic sequence
catcgtggtcgcc

SEQ ID NO: 14199 - DNA, 13 bp, Artificial Sequence
  synthetic sequence
aactactttgata

SEQ ID NO: 14200 - DNA, 13 bp, Artificial Sequence
  synthetic sequence
gattgtcattata

SEQ ID NO: 14201 - DNA, 13 bp, Artificial Sequence
  synthetic sequence
gttcgtaatagct

SEQ ID NO: 14202 - DNA, 13 bp, Artificial Sequence
  synthetic sequence
gggttgctccgag

SEQ ID NO: 14203 - DNA, 13 bp, Artificial Sequence
  synthetic sequence
aggtattctgtaa

SEQ ID NO: 14204 - DNA, 13 bp, Artificial Sequence
  synthetic sequence
cttaggaacatta

SEQ ID NO: 14205 - DNA, 13 bp, Artificial Sequence
  synthetic sequence
aggtataaatcat

SEQ ID NO: 14206 - DNA, 13 bp, Artificial Sequence
  synthetic sequence
tgagaatggtgct

SEQ ID NO: 14207 - DNA, 13 bp, Artificial Sequence
  synthetic sequence
tacttctgcttgg

SEQ ID NO: 14208 - DNA, 13 bp, Artificial Sequence
  synthetic sequence
ctggcaaccttcg

SEQ ID NO: 14209 - DNA, 13 bp, Artificial Sequence
  synthetic sequence
ttcatccttcatt

SEQ ID NO: 14210 - DNA, 13 bp, Artificial Sequence
  synthetic sequence
atttccaccaggt

SEQ ID NO: 14211 - DNA, 13 bp, Artificial Sequence
  synthetic sequence
ttcgcgaacgggc

SEQ ID NO: 14212 - DNA, 13 bp, Artificial Sequence
  synthetic sequence
agaaataatcgga

SEQ ID NO: 14213 - DNA, 13 bp, Artificial Sequence
  synthetic sequence
gccaaggcgagga

SEQ ID NO: 14214 - DNA, 13 bp, Artificial Sequence
  synthetic sequence
gtcgtaggcacgc

SEQ ID NO: 14215 - DNA, 13 bp, Artificial Sequence
  synthetic sequence
gcaatcccgtcga

SEQ ID NO: 14216 - DNA, 13 bp, Artificial Sequence
  synthetic sequence
cattgcttgaact

SEQ ID NO: 14217 - DNA, 13 bp, Artificial Sequence
  synthetic sequence
tgattgctcagca

SEQ ID NO: 14218 - DNA, 13 bp, Artificial Sequence
  synthetic sequence
aggatttagaagt

SEQ ID NO: 14219 - DNA, 13 bp, Artificial Sequence
  synthetic sequence
ttcattacatcta

SEQ ID NO: 14220 - DNA, 13 bp, Artificial Sequence
  synthetic sequence
caagcctctactg

SEQ ID NO: 14221 - DNA, 13 bp, Artificial Sequence
  synthetic sequence
cagcaggcgccta

SEQ ID NO: 14222 - DNA, 13 bp, Artificial Sequence
  synthetic sequence
tccatattgggca

SEQ ID NO: 14223 - DNA, 13 bp, Artificial Sequence
  synthetic sequence
atgttcatgccgc

SEQ ID NO: 14224 - DNA, 13 bp, Artificial Sequence
  synthetic sequence
ccaatgtggctag

SEQ ID NO: 14225 - DNA, 13 bp, Artificial Sequence
  synthetic sequence
ctttcatagtgga

SEQ ID NO: 14226 - DNA, 13 bp, Artificial Sequence
  synthetic sequence
agctgccaactgg

SEQ ID NO: 14227 - DNA, 13 bp, Artificial Sequence
  synthetic sequence
ggcggactacaaa

SEQ ID NO: 14228 - DNA, 13 bp, Artificial Sequence
  synthetic sequence
aagatcgttttcg

SEQ ID NO: 14229 - DNA, 13 bp, Artificial Sequence
  synthetic sequence
ctcgcggttgcca

SEQ ID NO: 14230 - DNA, 13 bp, Artificial Sequence
  synthetic sequence
tcacgccaccttt

SEQ ID NO: 14231 - DNA, 13 bp, Artificial Sequence
  synthetic sequence
gtctgtttggcgc

SEQ ID NO: 14232 - DNA, 13 bp, Artificial Sequence
  synthetic sequence
accatcgcgtgca

SEQ ID NO: 14233 - DNA, 13 bp, Artificial Sequence
  synthetic sequence
aagctgcgagggc

SEQ ID NO: 14234 - DNA, 13 bp, Artificial Sequence
  synthetic sequence
gtgttcgagcaaa

SEQ ID NO: 14235 - DNA, 13 bp, Artificial Sequence
  synthetic sequence
atggaatgccgga

SEQ ID NO: 14236 - DNA, 13 bp, Artificial Sequence
  synthetic sequence
aaatggcgatgat

SEQ ID NO: 14237 - DNA, 13 bp, Artificial Sequence
  synthetic sequence
accgcagagaaca

SEQ ID NO: 14238 - DNA, 13 bp, Artificial Sequence
  synthetic sequence
attcgcccagggc

SEQ ID NO: 14239 - DNA, 13 bp, Artificial Sequence
  synthetic sequence
cccgaaagctgtg

SEQ ID NO: 14240 - DNA, 13 bp, Artificial Sequence
  synthetic sequence
aaagtggttggat

SEQ ID NO: 14241 - DNA, 13 bp, Artificial Sequence
  synthetic sequence
aatggcgtgaact

SEQ ID NO: 14242 - DNA, 13 bp, Artificial Sequence
  synthetic sequence
gtcgcacacaccc

SEQ ID NO: 14243 - DNA, 13 bp, Artificial Sequence
  synthetic sequence
ttgctgttgcttt

SEQ ID NO: 14244 - DNA, 13 bp, Artificial Sequence
  synthetic sequence
gtcttcagcagtc

SEQ ID NO: 14245 - DNA, 13 bp, Artificial Sequence
  synthetic sequence
aacgctattccct

SEQ ID NO: 14246 - DNA, 13 bp, Artificial Sequence
  synthetic sequence
gaactgaagaaaa

SEQ ID NO: 14247 - DNA, 13 bp, Artificial Sequence
  synthetic sequence
gcttttaatgcca

SEQ ID NO: 14248 - DNA, 13 bp, Artificial Sequence
  synthetic sequence
gcgctgcaggaca

SEQ ID NO: 14249 - DNA, 13 bp, Artificial Sequence
  synthetic sequence
tctgacaattcct

SEQ ID NO: 14250 - DNA, 13 bp, Artificial Sequence
  synthetic sequence
gcttgatggagca

SEQ ID NO: 14251 - DNA, 13 bp, Artificial Sequence
  synthetic sequence
aagtcagacttac

SEQ ID NO: 14252 - DNA, 13 bp, Artificial Sequence
  synthetic sequence
tgacaatgcgaat

SEQ ID NO: 14253 - DNA, 13 bp, Artificial Sequence
  synthetic sequence
cgaaagattccgt

SEQ ID NO: 14254 - DNA, 13 bp, Artificial Sequence
  synthetic sequence
gtatcgcctgcag

SEQ ID NO: 14255 - DNA, 13 bp, Artificial Sequence
  synthetic sequence
gtaaaagttcgcc

SEQ ID NO: 14256 - DNA, 13 bp, Artificial Sequence
  synthetic sequence
tggccaaaccatc

SEQ ID NO: 14257 - DNA, 13 bp, Artificial Sequence
  synthetic sequence
agctggccgagct

SEQ ID NO: 14258 - DNA, 13 bp, Artificial Sequence
  synthetic sequence
cccacacctacct

SEQ ID NO: 14259 - DNA, 13 bp, Artificial Sequence
  synthetic sequence
atacaggttatgc

SEQ ID NO: 14260 - DNA, 13 bp, Artificial Sequence
  synthetic sequence
tgccattcgtgaa

SEQ ID NO: 14261 - DNA, 13 bp, Artificial Sequence
  synthetic sequence
acgtgtgcaaaca

SEQ ID NO: 14262 - DNA, 13 bp, Artificial Sequence
  synthetic sequence
tgaaatcaaactt

SEQ ID NO: 14263 - DNA, 13 bp, Artificial Sequence
  synthetic sequence
gcgatgtgattga

SEQ ID NO: 14264 - DNA, 13 bp, Artificial Sequence
  synthetic sequence
ggtagatcgccac

SEQ ID NO: 14265 - DNA, 13 bp, Artificial Sequence
  synthetic sequence
tagtagctattac

SEQ ID NO: 14266 - DNA, 13 bp, Artificial Sequence
  synthetic sequence
ttccttcattaca

SEQ ID NO: 14267 - DNA, 13 bp, Artificial Sequence
  synthetic sequence
agcttgaggggtt

SEQ ID NO: 14268 - DNA, 13 bp, Artificial Sequence
  synthetic sequence
tcggtcgacgagg

SEQ ID NO: 14269 - DNA, 13 bp, Artificial Sequence
  synthetic sequence
aaacggcgtggtg

SEQ ID NO: 14270 - DNA, 13 bp, Artificial Sequence
  synthetic sequence
attagtgcgggaa

SEQ ID NO: 14271 - DNA, 13 bp, Artificial Sequence
  synthetic sequence
ggaggctacttag

SEQ ID NO: 14272 - DNA, 13 bp, Artificial Sequence
  synthetic sequence
aattggttccaca

SEQ ID NO: 14273 - DNA, 13 bp, Artificial Sequence
  synthetic sequence
tatgatatcctct

SEQ ID NO: 14274 - DNA, 13 bp, Artificial Sequence
  synthetic sequence
gtggtatctctgc

SEQ ID NO: 14275 - DNA, 13 bp, Artificial Sequence
  synthetic sequence
tgcgcagtacctg

SEQ ID NO: 14276 - DNA, 13 bp, Artificial Sequence
  synthetic sequence
gcatgacagtaag

SEQ ID NO: 14277 - DNA, 13 bp, Artificial Sequence
  synthetic sequence
gagctcacagaat

SEQ ID NO: 14278 - DNA, 13 bp, Artificial Sequence
  synthetic sequence
gagcagggtctcc

SEQ ID NO: 14279 - DNA, 13 bp, Artificial Sequence
  synthetic sequence
caggttatattcc

SEQ ID NO: 14280 - DNA, 13 bp, Artificial Sequence
  synthetic sequence
acgtcatgtgcca

SEQ ID NO: 14281 - DNA, 13 bp, Artificial Sequence
  synthetic sequence
tttcactaaacca

SEQ ID NO: 14282 - DNA, 13 bp, Artificial Sequence
  synthetic sequence
caagatgcgcctc

SEQ ID NO: 14283 - DNA, 13 bp, Artificial Sequence
  synthetic sequence
gtttggcatggtg

SEQ ID NO: 14284 - DNA, 13 bp, Artificial Sequence
  synthetic sequence
ttggccgcgagat

SEQ ID NO: 14285 - DNA, 13 bp, Artificial Sequence
  synthetic sequence
acactgggttccc

SEQ ID NO: 14286 - DNA, 13 bp, Artificial Sequence
  synthetic sequence
agttgaatgggta

SEQ ID NO: 14287 - DNA, 13 bp, Artificial Sequence
  synthetic sequence
agaaactgttggg

SEQ ID NO: 14288 - DNA, 13 bp, Artificial Sequence
  synthetic sequence
aaacgctccttcc

SEQ ID NO: 14289 - DNA, 13 bp, Artificial Sequence
  synthetic sequence
tcgttcacgtaca

SEQ ID NO: 14290 - DNA, 13 bp, Artificial Sequence
  synthetic sequence
tcacgcgcgcgta

SEQ ID NO: 14291 - DNA, 13 bp, Artificial Sequence
  synthetic sequence
gttttgcagacag

SEQ ID NO: 14292 - DNA, 13 bp, Artificial Sequence
  synthetic sequence
attctgcggcgcg

SEQ ID NO: 14293 - DNA, 13 bp, Artificial Sequence
  synthetic sequence
ggtgaaaagttgt

SEQ ID NO: 14294 - DNA, 13 bp, Artificial Sequence
  synthetic sequence
caggttccgaaat

SEQ ID NO: 14295 - DNA, 13 bp, Artificial Sequence
  synthetic sequence
gccacacttattc

SEQ ID NO: 14296 - DNA, 13 bp, Artificial Sequence
  synthetic sequence
tactgaagtttgc

SEQ ID NO: 14297 - DNA, 13 bp, Artificial Sequence
  synthetic sequence
accgtcatcaccc

SEQ ID NO: 14298 - DNA, 13 bp, Artificial Sequence
  synthetic sequence
gcaagcgaatgtg

SEQ ID NO: 14299 - DNA, 13 bp, Artificial Sequence
  synthetic sequence
ttcggcatcgtca

SEQ ID NO: 14300 - DNA, 13 bp, Artificial Sequence
  synthetic sequence
aaagcagcaggtg

SEQ ID NO: 14301 - DNA, 13 bp, Artificial Sequence
  synthetic sequence
gccgtcggtggat

SEQ ID NO: 14302 - DNA, 13 bp, Artificial Sequence
  synthetic sequence
acgccgaaaccgc

SEQ ID NO: 14303 - DNA, 13 bp, Artificial Sequence
  synthetic sequence
acgcaggctgagg

SEQ ID NO: 14304 - DNA, 13 bp, Artificial Sequence
  synthetic sequence
attttcaaacctt

SEQ ID NO: 14305 - DNA, 13 bp, Artificial Sequence
  synthetic sequence
catggcagcacgt

SEQ ID NO: 14306 - DNA, 13 bp, Artificial Sequence
  synthetic sequence
ggcttcggtgttc

SEQ ID NO: 14307 - DNA, 13 bp, Artificial Sequence
  synthetic sequence
ttacgaaaatcgc

SEQ ID NO: 14308 - DNA, 13 bp, Artificial Sequence
  synthetic sequence
catttgggttggg

SEQ ID NO: 14309 - DNA, 13 bp, Artificial Sequence
  synthetic sequence
gcagcgcatgcac

SEQ ID NO: 14310 - DNA, 13 bp, Artificial Sequence
  synthetic sequence
ccttccatgtcac

SEQ ID NO: 14311 - DNA, 13 bp, Artificial Sequence
  synthetic sequence
tggccatgccttt

SEQ ID NO: 14312 - DNA, 13 bp, Artificial Sequence
  synthetic sequence
cgtggagtcgctc

SEQ ID NO: 14313 - DNA, 13 bp, Artificial Sequence
  synthetic sequence
cttaatgcttata

SEQ ID NO: 14314 - DNA, 13 bp, Artificial Sequence
  synthetic sequence
ccgtcgagagttt

SEQ ID NO: 14315 - DNA, 13 bp, Artificial Sequence
  synthetic sequence
aaaactttcgtta

SEQ ID NO: 14316 - DNA, 13 bp, Artificial Sequence
  synthetic sequence
ctcatcgagcatc

SEQ ID NO: 14317 - DNA, 13 bp, Artificial Sequence
  synthetic sequence
tacgccctacacg

SEQ ID NO: 14318 - DNA, 13 bp, Artificial Sequence
  synthetic sequence
catgcgattgctc

SEQ ID NO: 14319 - DNA, 13 bp, Artificial Sequence
  synthetic sequence
ctgcggccgatgt

SEQ ID NO: 14320 - DNA, 13 bp, Artificial Sequence
  synthetic sequence
tgattgccgccca

SEQ ID NO: 14321 - DNA, 13 bp, Artificial Sequence
  synthetic sequence
gtaacgatcagct

SEQ ID NO: 14322 - DNA, 13 bp, Artificial Sequence
  synthetic sequence
gctcgaatgcctg

SEQ ID NO: 14323 - DNA, 13 bp, Artificial Sequence
  synthetic sequence
atggcttttaccg

SEQ ID NO: 14324 - DNA, 13 bp, Artificial Sequence
  synthetic sequence
gcccacgttgacg

SEQ ID NO: 14325 - DNA, 13 bp, Artificial Sequence
  synthetic sequence
ccgcatatgtaat

SEQ ID NO: 14326 - DNA, 13 bp, Artificial Sequence
  synthetic sequence
cgaagctggtcaa

SEQ ID NO: 14327 - DNA, 13 bp, Artificial Sequence
  synthetic sequence
ggcctacacggtg

SEQ ID NO: 14328 - DNA, 13 bp, Artificial Sequence
  synthetic sequence
agaccctgttcga

SEQ ID NO: 14329 - DNA, 13 bp, Artificial Sequence
  synthetic sequence
aggccatgggcag

SEQ ID NO: 14330 - DNA, 13 bp, Artificial Sequence
  synthetic sequence
acaaaactattgc

SEQ ID NO: 14331 - DNA, 13 bp, Artificial Sequence
  synthetic sequence
accttcctgatcg

SEQ ID NO: 14332 - DNA, 13 bp, Artificial Sequence
  synthetic sequence
tatcgctacaaca

SEQ ID NO: 14333 - DNA, 13 bp, Artificial Sequence
  synthetic sequence
cgtttgccacggg

SEQ ID NO: 14334 - DNA, 13 bp, Artificial Sequence
  synthetic sequence
tgcggcaacagta

SEQ ID NO: 14335 - DNA, 13 bp, Artificial Sequence
  synthetic sequence
tttgcctgcatat

SEQ ID NO: 14336 - DNA, 13 bp, Artificial Sequence
  synthetic sequence
ttgtgtctggtgc

SEQ ID NO: 14337 - DNA, 13 bp, Artificial Sequence
  synthetic sequence
cagaggttggagt

SEQ ID NO: 14338 - DNA, 13 bp, Artificial Sequence
  synthetic sequence
tagtggtcgtaga

SEQ ID NO: 14339 - DNA, 13 bp, Artificial Sequence
  synthetic sequence
tcagtgcttcgaa

SEQ ID NO: 14340 - DNA, 13 bp, Artificial Sequence
  synthetic sequence
gccccaaataaca

SEQ ID NO: 14341 - DNA, 13 bp, Artificial Sequence
  synthetic sequence
tgcagaacgcaca

SEQ ID NO: 14342 - DNA, 13 bp, Artificial Sequence
  synthetic sequence
agttgctctctta

SEQ ID NO: 14343 - DNA, 13 bp, Artificial Sequence
  synthetic sequence
gcagaagactcgc

SEQ ID NO: 14344 - DNA, 13 bp, Artificial Sequence
  synthetic sequence
gctagtcaaactc

SEQ ID NO: 14345 - DNA, 13 bp, Artificial Sequence
  synthetic sequence
gttactaccacaa

SEQ ID NO: 14346 - DNA, 13 bp, Artificial Sequence
  synthetic sequence
tatttcccgggag

SEQ ID NO: 14347 - DNA, 13 bp, Artificial Sequence
  synthetic sequence
gagcggcatcgca

SEQ ID NO: 14348 - DNA, 13 bp, Artificial Sequence
  synthetic sequence
actgataaacgcc

SEQ ID NO: 14349 - DNA, 13 bp, Artificial Sequence
  synthetic sequence
acaaagaaaatag

SEQ ID NO: 14350 - DNA, 13 bp, Artificial Sequence
  synthetic sequence
ggcttcactagct

SEQ ID NO: 14351 - DNA, 13 bp, Artificial Sequence
  synthetic sequence
atactcacccgtg

SEQ ID NO: 14352 - DNA, 13 bp, Artificial Sequence
  synthetic sequence
ccaccctcgacga

SEQ ID NO: 14353 - DNA, 13 bp, Artificial Sequence
  synthetic sequence
atgaataaccatt

SEQ ID NO: 14354 - DNA, 13 bp, Artificial Sequence
  synthetic sequence
gctgaagctcggc

SEQ ID NO: 14355 - DNA, 13 bp, Artificial Sequence
  synthetic sequence
gtttcccaaattc

SEQ ID NO: 14356 - DNA, 13 bp, Artificial Sequence
  synthetic sequence
tgaacccgcttta

SEQ ID NO: 14357 - DNA, 13 bp, Artificial Sequence
  synthetic sequence
agcacgacaattg

SEQ ID NO: 14358 - DNA, 13 bp, Artificial Sequence
  synthetic sequence
cgagctggccgaa

SEQ ID NO: 14359 - DNA, 13 bp, Artificial Sequence
  synthetic sequence
ttatggcataaac

SEQ ID NO: 14360 - DNA, 13 bp, Artificial Sequence
  synthetic sequence
cagctcgtccatc

SEQ ID NO: 14361 - DNA, 13 bp, Artificial Sequence
  synthetic sequence
aaagaaattgccc

SEQ ID NO: 14362 - DNA, 13 bp, Artificial Sequence
  synthetic sequence
ttgtattggcgga

SEQ ID NO: 14363 - DNA, 13 bp, Artificial Sequence
  synthetic sequence
cttatcagggtca

SEQ ID NO: 14364 - DNA, 13 bp, Artificial Sequence
  synthetic sequence
gatatcaatggta

SEQ ID NO: 14365 - DNA, 13 bp, Artificial Sequence
  synthetic sequence
tgccattaaaaga

SEQ ID NO: 14366 - DNA, 13 bp, Artificial Sequence
  synthetic sequence
ccatcgccgcgaa

SEQ ID NO: 14367 - DNA, 13 bp, Artificial Sequence
  synthetic sequence
gataaacaaattg

SEQ ID NO: 14368 - DNA, 13 bp, Artificial Sequence
  synthetic sequence
atggcgaaagtcg

SEQ ID NO: 14369 - DNA, 13 bp, Artificial Sequence
  synthetic sequence
ctcggcgtttcat

SEQ ID NO: 14370 - DNA, 13 bp, Artificial Sequence
  synthetic sequence
ttcaccgtggcat

SEQ ID NO: 14371 - DNA, 13 bp, Artificial Sequence
  synthetic sequence
atatggctcaccg

SEQ ID NO: 14372 - DNA, 13 bp, Artificial Sequence
  synthetic sequence
ccaacgcgcttgg

SEQ ID NO: 14373 - DNA, 13 bp, Artificial Sequence
  synthetic sequence
tttgctcttacaa

SEQ ID NO: 14374 - DNA, 13 bp, Artificial Sequence
  synthetic sequence
cttcctgcgataa

SEQ ID NO: 14375 - DNA, 13 bp, Artificial Sequence
  synthetic sequence
gtaattcgctaac

SEQ ID NO: 14376 - DNA, 13 bp, Artificial Sequence
  synthetic sequence
caaacacagttca

SEQ ID NO: 14377 - DNA, 13 bp, Artificial Sequence
  synthetic sequence
tgagcgtcgcgaa

SEQ ID NO: 14378 - DNA, 13 bp, Artificial Sequence
  synthetic sequence
ctttgtattggac

SEQ ID NO: 14379 - DNA, 13 bp, Artificial Sequence
  synthetic sequence
cggtgatggcgac

SEQ ID NO: 14380 - DNA, 13 bp, Artificial Sequence
  synthetic sequence
taaggcctgccag

SEQ ID NO: 14381 - DNA, 13 bp, Artificial Sequence
  synthetic sequence
tgctggaaagcct

SEQ ID NO: 14382 - DNA, 13 bp, Artificial Sequence
  synthetic sequence
tggtctatttgac

SEQ ID NO: 14383 - DNA, 13 bp, Artificial Sequence
  synthetic sequence
tgatcggcccgct

SEQ ID NO: 14384 - DNA, 13 bp, Artificial Sequence
  synthetic sequence
acttgacccactt

SEQ ID NO: 14385 - DNA, 13 bp, Artificial Sequence
  synthetic sequence
gaatcaatcctac

SEQ ID NO: 14386 - DNA, 13 bp, Artificial Sequence
  synthetic sequence
aaaacaaagtccc

SEQ ID NO: 14387 - DNA, 13 bp, Artificial Sequence
  synthetic sequence
tacggttcgccgc

SEQ ID NO: 14388 - DNA, 13 bp, Artificial Sequence
  synthetic sequence
gcctatccacgct

SEQ ID NO: 14389 - DNA, 13 bp, Artificial Sequence
  synthetic sequence
taagctggagccg

SEQ ID NO: 14390 - DNA, 13 bp, Artificial Sequence
  synthetic sequence
gatgcgctcgtgc

SEQ ID NO: 14391 - DNA, 13 bp, Artificial Sequence
  synthetic sequence
cacgcttagcata

SEQ ID NO: 14392 - DNA, 13 bp, Artificial Sequence
  synthetic sequence
cctgctggaccac

SEQ ID NO: 14393 - DNA, 13 bp, Artificial Sequence
  synthetic sequence
tcttggtcgagag

SEQ ID NO: 14394 - DNA, 13 bp, Artificial Sequence
  synthetic sequence
taccgccattttg

SEQ ID NO: 14395 - DNA, 13 bp, Artificial Sequence
  synthetic sequence
ttggtgcactaag

SEQ ID NO: 14396 - DNA, 13 bp, Artificial Sequence
  synthetic sequence
caaagaactgtaa

SEQ ID NO: 14397 - DNA, 13 bp, Artificial Sequence
  synthetic sequence
ccggctctcgatc

SEQ ID NO: 14398 - DNA, 13 bp, Artificial Sequence
  synthetic sequence
ggtcagcatacag

SEQ ID NO: 14399 - DNA, 13 bp, Artificial Sequence
  synthetic sequence
ccattaaataaca

SEQ ID NO: 14400 - DNA, 13 bp, Artificial Sequence
  synthetic sequence
atcccaatgtctt

SEQ ID NO: 14401 - DNA, 13 bp, Artificial Sequence
  synthetic sequence
aattcagggtcaa

SEQ ID NO: 14402 - DNA, 13 bp, Artificial Sequence
  synthetic sequence
ccggctcggttac

SEQ ID NO: 14403 - DNA, 13 bp, Artificial Sequence
  synthetic sequence
agacggtgattgc

SEQ ID NO: 14404 - DNA, 13 bp, Artificial Sequence
  synthetic sequence
aggacaaattccc

SEQ ID NO: 14405 - DNA, 13 bp, Artificial Sequence
  synthetic sequence
ttattggcttagc

SEQ ID NO: 14406 - DNA, 13 bp, Artificial Sequence
  synthetic sequence
gtactatatcatt

SEQ ID NO: 14407 - DNA, 13 bp, Artificial Sequence
  synthetic sequence
ccgtgatagctcg

SEQ ID NO: 14408 - DNA, 13 bp, Artificial Sequence
  synthetic sequence
gtgacctttgggt

SEQ ID NO: 14409 - DNA, 13 bp, Artificial Sequence
  synthetic sequence
cgtgatcgcgttc

SEQ ID NO: 14410 - DNA, 13 bp, Artificial Sequence
  synthetic sequence
ctcaaattagccc

SEQ ID NO: 14411 - DNA, 13 bp, Artificial Sequence
  synthetic sequence
tggcgagaccgga

SEQ ID NO: 14412 - DNA, 13 bp, Artificial Sequence
  synthetic sequence
tgttgcatttaca

SEQ ID NO: 14413 - DNA, 13 bp, Artificial Sequence
  synthetic sequence
tcgatccaataag

SEQ ID NO: 14414 - DNA, 13 bp, Artificial Sequence
  synthetic sequence
gtccgatgaccga

SEQ ID NO: 14415 - DNA, 13 bp, Artificial Sequence
  synthetic sequence
cagtaccagtaag

SEQ ID NO: 14416 - DNA, 13 bp, Artificial Sequence
  synthetic sequence
agccagtttgcca

SEQ ID NO: 14417 - DNA, 13 bp, Artificial Sequence
  synthetic sequence
gttaagacaattc

SEQ ID NO: 14418 - DNA, 13 bp, Artificial Sequence
  synthetic sequence
tttcttttcctta

SEQ ID NO: 14419 - DNA, 13 bp, Artificial Sequence
  synthetic sequence
ccttgatcgcccc

SEQ ID NO: 14420 - DNA, 13 bp, Artificial Sequence
  synthetic sequence
cttttgctcaatc

SEQ ID NO: 14421 - DNA, 13 bp, Artificial Sequence
  synthetic sequence
cggacatcgccaa

SEQ ID NO: 14422 - DNA, 13 bp, Artificial Sequence
  synthetic sequence
accgcggaggtga

SEQ ID NO: 14423 - DNA, 13 bp, Artificial Sequence
  synthetic sequence
ggcggatattcgt

SEQ ID NO: 14424 - DNA, 13 bp, Artificial Sequence
  synthetic sequence
ggctgtgcgctta

SEQ ID NO: 14425 - DNA, 13 bp, Artificial Sequence
  synthetic sequence
caggatattactg

SEQ ID NO: 14426 - DNA, 13 bp, Artificial Sequence
  synthetic sequence
gcgctaacacaat

SEQ ID NO: 14427 - DNA, 13 bp, Artificial Sequence
  synthetic sequence
gtattaaccgcgg

SEQ ID NO: 14428 - DNA, 13 bp, Artificial Sequence
  synthetic sequence
ttgtgcagggcac

SEQ ID NO: 14429 - DNA, 13 bp, Artificial Sequence
  synthetic sequence
tgtctctcatggc

SEQ ID NO: 14430 - DNA, 13 bp, Artificial Sequence
  synthetic sequence
cggcaaatgtgaa

SEQ ID NO: 14431 - DNA, 13 bp, Artificial Sequence
  synthetic sequence
tggagtagtcgac

SEQ ID NO: 14432 - DNA, 13 bp, Artificial Sequence
  synthetic sequence
ccgcgttgtttca

SEQ ID NO: 14433 - DNA, 13 bp, Artificial Sequence
  synthetic sequence
ggtggctgttggc

SEQ ID NO: 14434 - DNA, 13 bp, Artificial Sequence
  synthetic sequence
gatccctgctggt

SEQ ID NO: 14435 - DNA, 13 bp, Artificial Sequence
  synthetic sequence
tgactttattgga

SEQ ID NO: 14436 - DNA, 13 bp, Artificial Sequence
  synthetic sequence
gcagcacgtagaa

SEQ ID NO: 14437 - DNA, 13 bp, Artificial Sequence
  synthetic sequence
cacggattgactg

SEQ ID NO: 14438 - DNA, 13 bp, Artificial Sequence
  synthetic sequence
cgaaccggctttc

SEQ ID NO: 14439 - DNA, 13 bp, Artificial Sequence
  synthetic sequence
gcgattgcataaa

SEQ ID NO: 14440 - DNA, 13 bp, Artificial Sequence
  synthetic sequence
acgaggcttatgt

SEQ ID NO: 14441 - DNA, 13 bp, Artificial Sequence
  synthetic sequence
aagtctatgttga

SEQ ID NO: 14442 - DNA, 13 bp, Artificial Sequence
  synthetic sequence
acatcgaggaggg

SEQ ID NO: 14443 - DNA, 13 bp, Artificial Sequence
  synthetic sequence
atcatcggtcacg

SEQ ID NO: 14444 - DNA, 13 bp, Artificial Sequence
  synthetic sequence
gatggcttccatc

SEQ ID NO: 14445 - DNA, 13 bp, Artificial Sequence
  synthetic sequence
gatatccgcaacc

SEQ ID NO: 14446 - DNA, 13 bp, Artificial Sequence
  synthetic sequence
gggtatcggtgtg

SEQ ID NO: 14447 - DNA, 13 bp, Artificial Sequence
  synthetic sequence
aacctacaatcat

SEQ ID NO: 14448 - DNA, 13 bp, Artificial Sequence
  synthetic sequence
gatcccaagccct

SEQ ID NO: 14449 - DNA, 13 bp, Artificial Sequence
  synthetic sequence
aattgttcaaagc

SEQ ID NO: 14450 - DNA, 13 bp, Artificial Sequence
  synthetic sequence
aaactcactgaga

SEQ ID NO: 14451 - DNA, 13 bp, Artificial Sequence
  synthetic sequence
ttctgctccttta

SEQ ID NO: 14452 - DNA, 13 bp, Artificial Sequence
  synthetic sequence
tgatgtctaacag

SEQ ID NO: 14453 - DNA, 13 bp, Artificial Sequence
  synthetic sequence
ccttttgccctct

SEQ ID NO: 14454 - DNA, 13 bp, Artificial Sequence
  synthetic sequence
ttatgctgaccca

SEQ ID NO: 14455 - DNA, 13 bp, Artificial Sequence
  synthetic sequence
aaaacaggggaaa

SEQ ID NO: 14456 - DNA, 13 bp, Artificial Sequence
  synthetic sequence
gtgtgcttacaag

SEQ ID NO: 14457 - DNA, 13 bp, Artificial Sequence
  synthetic sequence
cgatcaagtgcgt

SEQ ID NO: 14458 - DNA, 13 bp, Artificial Sequence
  synthetic sequence
gcaatggcgttgg

SEQ ID NO: 14459 - DNA, 13 bp, Artificial Sequence
  synthetic sequence
aacaggagccact

SEQ ID NO: 14460 - DNA, 13 bp, Artificial Sequence
  synthetic sequence
aggctgaaaacca

SEQ ID NO: 14461 - DNA, 13 bp, Artificial Sequence
  synthetic sequence
gatcaagcatgac

SEQ ID NO: 14462 - DNA, 13 bp, Artificial Sequence
  synthetic sequence
tcggtgccgcagt

SEQ ID NO: 14463 - DNA, 13 bp, Artificial Sequence
  synthetic sequence
tttaatccactag

SEQ ID NO: 14464 - DNA, 13 bp, Artificial Sequence
  synthetic sequence
gacctgggcaaga

SEQ ID NO: 14465 - DNA, 13 bp, Artificial Sequence
  synthetic sequence
aatgaacctgcct

SEQ ID NO: 14466 - DNA, 13 bp, Artificial Sequence
  synthetic sequence
tggttgatctgaa

SEQ ID NO: 14467 - DNA, 13 bp, Artificial Sequence
  synthetic sequence
ccatcgcgtcgag

SEQ ID NO: 14468 - DNA, 13 bp, Artificial Sequence
  synthetic sequence
aagttcctgtcgc

SEQ ID NO: 14469 - DNA, 13 bp, Artificial Sequence
  synthetic sequence
gcccttgaggacc

SEQ ID NO: 14470 - DNA, 13 bp, Artificial Sequence
  synthetic sequence
gcgctgccttcga

SEQ ID NO: 14471 - DNA, 13 bp, Artificial Sequence
  synthetic sequence
tagttcgacaaag

SEQ ID NO: 14472 - DNA, 13 bp, Artificial Sequence
  synthetic sequence
caagagcgctggg

SEQ ID NO: 14473 - DNA, 13 bp, Artificial Sequence
  synthetic sequence
gtaattacctcta

SEQ ID NO: 14474 - DNA, 13 bp, Artificial Sequence
  synthetic sequence
actttgccgccta

SEQ ID NO: 14475 - DNA, 13 bp, Artificial Sequence
  synthetic sequence
tgtccagggacaa

SEQ ID NO: 14476 - DNA, 13 bp, Artificial Sequence
  synthetic sequence
ctttcgctgagct

SEQ ID NO: 14477 - DNA, 13 bp, Artificial Sequence
  synthetic sequence
tcagtatcggcga

SEQ ID NO: 14478 - DNA, 13 bp, Artificial Sequence
  synthetic sequence
cagcacatgaagc

SEQ ID NO: 14479 - DNA, 13 bp, Artificial Sequence
  synthetic sequence
ggtgagcgcatcc

SEQ ID NO: 14480 - DNA, 13 bp, Artificial Sequence
  synthetic sequence
ggccacagtgcca

SEQ ID NO: 14481 - DNA, 13 bp, Artificial Sequence
  synthetic sequence
tgccatagagttg

SEQ ID NO: 14482 - DNA, 13 bp, Artificial Sequence
  synthetic sequence
gcgcaccacatct

SEQ ID NO: 14483 - DNA, 13 bp, Artificial Sequence
  synthetic sequence
gccagcaggagat

SEQ ID NO: 14484 - DNA, 13 bp, Artificial Sequence
  synthetic sequence
atccttttcatag

SEQ ID NO: 14485 - DNA, 13 bp, Artificial Sequence
  synthetic sequence
acaagttcagcgt

SEQ ID NO: 14486 - DNA, 13 bp, Artificial Sequence
  synthetic sequence
ctcgcagaaccct

SEQ ID NO: 14487 - DNA, 13 bp, Artificial Sequence
  synthetic sequence
aacagccggagcc

SEQ ID NO: 14488 - DNA, 13 bp, Artificial Sequence
  synthetic sequence
aagtttaatggcc

SEQ ID NO: 14489 - DNA, 13 bp, Artificial Sequence
  synthetic sequence
cacagggaggaat

SEQ ID NO: 14490 - DNA, 13 bp, Artificial Sequence
  synthetic sequence
ttcgccaccggca

SEQ ID NO: 14491 - DNA, 13 bp, Artificial Sequence
  synthetic sequence
aatacgattgata

SEQ ID NO: 14492 - DNA, 13 bp, Artificial Sequence
  synthetic sequence
ctggctacgaccc

SEQ ID NO: 14493 - DNA, 13 bp, Artificial Sequence
  synthetic sequence
tctttgccaatga

SEQ ID NO: 14494 - DNA, 13 bp, Artificial Sequence
  synthetic sequence
ctctgcaaattcg

SEQ ID NO: 14495 - DNA, 13 bp, Artificial Sequence
  synthetic sequence
atgcacatccaat

SEQ ID NO: 14496 - DNA, 13 bp, Artificial Sequence
  synthetic sequence
aagagcactttca

SEQ ID NO: 14497 - DNA, 13 bp, Artificial Sequence
  synthetic sequence
ccctcggtgccta

SEQ ID NO: 14498 - DNA, 13 bp, Artificial Sequence
  synthetic sequence
acgttgcgtactg

SEQ ID NO: 14499 - DNA, 13 bp, Artificial Sequence
  synthetic sequence
cgtcctcggaaac

SEQ ID NO: 14500 - DNA, 13 bp, Artificial Sequence
  synthetic sequence
attatgctcaccc

SEQ ID NO: 14501 - DNA, 13 bp, Artificial Sequence
  synthetic sequence
ggcccaggttgtc

SEQ ID NO: 14502 - DNA, 13 bp, Artificial Sequence
  synthetic sequence
agccggtctattt

SEQ ID NO: 14503 - DNA, 13 bp, Artificial Sequence
  synthetic sequence
agtaggtcgcatt

SEQ ID NO: 14504 - DNA, 13 bp, Artificial Sequence
  synthetic sequence
tgatggtggcgtc

SEQ ID NO: 14505 - DNA, 13 bp, Artificial Sequence
  synthetic sequence
atcgatcgtctcg

SEQ ID NO: 14506 - DNA, 13 bp, Artificial Sequence
  synthetic sequence
gggaagagggtcc

SEQ ID NO: 14507 - DNA, 13 bp, Artificial Sequence
  synthetic sequence
accaggcgactta

SEQ ID NO: 14508 - DNA, 13 bp, Artificial Sequence
  synthetic sequence
aagcgcgggcatt

SEQ ID NO: 14509 - DNA, 13 bp, Artificial Sequence
  synthetic sequence
tggctgatgaaga

SEQ ID NO: 14510 - DNA, 13 bp, Artificial Sequence
  synthetic sequence
agccctgccactg

SEQ ID NO: 14511 - DNA, 13 bp, Artificial Sequence
  synthetic sequence
cacctcgaccttt

SEQ ID NO: 14512 - DNA, 13 bp, Artificial Sequence
  synthetic sequence
cgtcgaccttcac

SEQ ID NO: 14513 - DNA, 13 bp, Artificial Sequence
  synthetic sequence
cgttgctgttggc

SEQ ID NO: 14514 - DNA, 13 bp, Artificial Sequence
  synthetic sequence
tgatgaatcgcgt

SEQ ID NO: 14515 - DNA, 13 bp, Artificial Sequence
  synthetic sequence
tgatgcggttgga

SEQ ID NO: 14516 - DNA, 13 bp, Artificial Sequence
  synthetic sequence
gtgaacgacggat

SEQ ID NO: 14517 - DNA, 13 bp, Artificial Sequence
  synthetic sequence
gacaccttgaggt

SEQ ID NO: 14518 - DNA, 13 bp, Artificial Sequence
  synthetic sequence
gtattgatgtcag

SEQ ID NO: 14519 - DNA, 13 bp, Artificial Sequence
  synthetic sequence
gccacggcgaagt

SEQ ID NO: 14520 - DNA, 13 bp, Artificial Sequence
  synthetic sequence
accaaaccgttat

SEQ ID NO: 14521 - DNA, 13 bp, Artificial Sequence
  synthetic sequence
aatggaccaataa

SEQ ID NO: 14522 - DNA, 13 bp, Artificial Sequence
  synthetic sequence
gacagcctcgcac

SEQ ID NO: 14523 - DNA, 13 bp, Artificial Sequence
  synthetic sequence
gacagaaaagtat

SEQ ID NO: 14524 - DNA, 13 bp, Artificial Sequence
  synthetic sequence
tttacggtaaatt

SEQ ID NO: 14525 - DNA, 13 bp, Artificial Sequence
  synthetic sequence
gactggaaaggca

SEQ ID NO: 14526 - DNA, 13 bp, Artificial Sequence
  synthetic sequence
tctcaagggcatc

SEQ ID NO: 14527 - DNA, 13 bp, Artificial Sequence
  synthetic sequence
tcgccgacatggc

SEQ ID NO: 14528 - DNA, 13 bp, Artificial Sequence
  synthetic sequence
tagggaagcttat

SEQ ID NO: 14529 - DNA, 13 bp, Artificial Sequence
  synthetic sequence
ctggctgttttgg

SEQ ID NO: 14530 - DNA, 13 bp, Artificial Sequence
  synthetic sequence
ttggagggaattc

SEQ ID NO: 14531 - DNA, 13 bp, Artificial Sequence
  synthetic sequence
aaggttgttgttc

SEQ ID NO: 14532 - DNA, 13 bp, Artificial Sequence
  synthetic sequence
ttggtttctacac

SEQ ID NO: 14533 - DNA, 13 bp, Artificial Sequence
  synthetic sequence
actgggtgtgtct

SEQ ID NO: 14534 - DNA, 13 bp, Artificial Sequence
  synthetic sequence
tcaacgaacgcat

SEQ ID NO: 14535 - DNA, 13 bp, Artificial Sequence
  synthetic sequence
gtggacatctccc

SEQ ID NO: 14536 - DNA, 13 bp, Artificial Sequence
  synthetic sequence
ggagtttcttctg

SEQ ID NO: 14537 - DNA, 13 bp, Artificial Sequence
  synthetic sequence
gacggcgtgctct

SEQ ID NO: 14538 - DNA, 13 bp, Artificial Sequence
  synthetic sequence
cgagccgttcttg

SEQ ID NO: 14539 - DNA, 13 bp, Artificial Sequence
  synthetic sequence
tccggcaagttcg

SEQ ID NO: 14540 - DNA, 13 bp, Artificial Sequence
  synthetic sequence
ttgcatctgacgg

SEQ ID NO: 14541 - DNA, 13 bp, Artificial Sequence
  synthetic sequence
gggcattgacgtt

SEQ ID NO: 14542 - DNA, 13 bp, Artificial Sequence
  synthetic sequence
tattcaaggtttt

SEQ ID NO: 14543 - DNA, 13 bp, Artificial Sequence
  synthetic sequence
agcgcgatagtgc

SEQ ID NO: 14544 - DNA, 13 bp, Artificial Sequence
  synthetic sequence
accgtgcagcagc

SEQ ID NO: 14545 - DNA, 13 bp, Artificial Sequence
  synthetic sequence
ccatgatgtcatc

SEQ ID NO: 14546 - DNA, 13 bp, Artificial Sequence
  synthetic sequence
ctcggagcgctga

SEQ ID NO: 14547 - DNA, 13 bp, Artificial Sequence
  synthetic sequence
tccattatcttct

SEQ ID NO: 14548 - DNA, 13 bp, Artificial Sequence
  synthetic sequence
gaccaacccgaaa

SEQ ID NO: 14549 - DNA, 13 bp, Artificial Sequence
  synthetic sequence
tcaaaatagctat

SEQ ID NO: 14550 - DNA, 13 bp, Artificial Sequence
  synthetic sequence
gacgagattgtgc

SEQ ID NO: 14551 - DNA, 13 bp, Artificial Sequence
  synthetic sequence
cgaagtggcgaaa

SEQ ID NO: 14552 - DNA, 13 bp, Artificial Sequence
  synthetic sequence
tcatccgttgagg

SEQ ID NO: 14553 - DNA, 13 bp, Artificial Sequence
  synthetic sequence
gcaaacccgtatt

SEQ ID NO: 14554 - DNA, 13 bp, Artificial Sequence
  synthetic sequence
ggtaaccggcaat

SEQ ID NO: 14555 - DNA, 13 bp, Artificial Sequence
  synthetic sequence
ggccgtgagtttt

SEQ ID NO: 14556 - DNA, 13 bp, Artificial Sequence
  synthetic sequence
ggcatattctgtc

SEQ ID NO: 14557 - DNA, 13 bp, Artificial Sequence
  synthetic sequence
ccttgttcattat

SEQ ID NO: 14558 - DNA, 13 bp, Artificial Sequence
  synthetic sequence
ctcttcacttcgt

SEQ ID NO: 14559 - DNA, 13 bp, Artificial Sequence
  synthetic sequence
acttaaaagccga

SEQ ID NO: 14560 - DNA, 13 bp, Artificial Sequence
  synthetic sequence
aaagcgctctcta

SEQ ID NO: 14561 - DNA, 13 bp, Artificial Sequence
  synthetic sequence
aagtaccggtgag

SEQ ID NO: 14562 - DNA, 13 bp, Artificial Sequence
  synthetic sequence
acgtaccgattcg

SEQ ID NO: 14563 - DNA, 13 bp, Artificial Sequence
  synthetic sequence
gatttgaaatagc

SEQ ID NO: 14564 - DNA, 13 bp, Artificial Sequence
  synthetic sequence
cgtggcgctgatt

SEQ ID NO: 14565 - DNA, 13 bp, Artificial Sequence
  synthetic sequence
gccgggctgtcaa

SEQ ID NO: 14566 - DNA, 13 bp, Artificial Sequence
  synthetic sequence
ctcaggttgaggt

SEQ ID NO: 14567 - DNA, 13 bp, Artificial Sequence
  synthetic sequence
cgaaactacggtc

SEQ ID NO: 14568 - DNA, 13 bp, Artificial Sequence
  synthetic sequence
tcctgagtcatgt

SEQ ID NO: 14569 - DNA, 13 bp, Artificial Sequence
  synthetic sequence
gctcaacaaagga

SEQ ID NO: 14570 - DNA, 13 bp, Artificial Sequence
  synthetic sequence
aattgcagtcctg

SEQ ID NO: 14571 - DNA, 13 bp, Artificial Sequence
  synthetic sequence
gagagcgatttat

SEQ ID NO: 14572 - DNA, 13 bp, Artificial Sequence
  synthetic sequence
attgatacagcgt

SEQ ID NO: 14573 - DNA, 13 bp, Artificial Sequence
  synthetic sequence
actacagccgcgc

SEQ ID NO: 14574 - DNA, 13 bp, Artificial Sequence
  synthetic sequence
ctattccaatcac

SEQ ID NO: 14575 - DNA, 13 bp, Artificial Sequence
  synthetic sequence
ctttggcctcgat

SEQ ID NO: 14576 - DNA, 13 bp, Artificial Sequence
  synthetic sequence
catcgtccttgcg

SEQ ID NO: 14577 - DNA, 13 bp, Artificial Sequence
  synthetic sequence
ccaacacgcgacg

SEQ ID NO: 14578 - DNA, 13 bp, Artificial Sequence
  synthetic sequence
ccagtccccagta

SEQ ID NO: 14579 - DNA, 13 bp, Artificial Sequence
  synthetic sequence
atggcggtgcatc

SEQ ID NO: 14580 - DNA, 13 bp, Artificial Sequence
  synthetic sequence
gcgggcggttatt

SEQ ID NO: 14581 - DNA, 13 bp, Artificial Sequence
  synthetic sequence
tgcagatttccga

SEQ ID NO: 14582 - DNA, 13 bp, Artificial Sequence
  synthetic sequence
cgatttatccgct

SEQ ID NO: 14583 - DNA, 13 bp, Artificial Sequence
  synthetic sequence
gatttgcgtgttg

SEQ ID NO: 14584 - DNA, 13 bp, Artificial Sequence
  synthetic sequence
ttcgtcggtgttg

SEQ ID NO: 14585 - DNA, 13 bp, Artificial Sequence
  synthetic sequence
aactgggcgacaa

SEQ ID NO: 14586 - DNA, 13 bp, Artificial Sequence
  synthetic sequence
gatattgatcaat

SEQ ID NO: 14587 - DNA, 13 bp, Artificial Sequence
  synthetic sequence
ggtggcggtcagt

SEQ ID NO: 14588 - DNA, 13 bp, Artificial Sequence
  synthetic sequence
cggtgacgttcac

SEQ ID NO: 14589 - DNA, 13 bp, Artificial Sequence
  synthetic sequence
aattacagcttga

SEQ ID NO: 14590 - DNA, 13 bp, Artificial Sequence
  synthetic sequence
ttcgataatgcgg

SEQ ID NO: 14591 - DNA, 13 bp, Artificial Sequence
  synthetic sequence
agtcgctgtttaa

SEQ ID NO: 14592 - DNA, 13 bp, Artificial Sequence
  synthetic sequence
ccagacgccgcat

SEQ ID NO: 14593 - DNA, 13 bp, Artificial Sequence
  synthetic sequence
atcaggaaaccaa

SEQ ID NO: 14594 - DNA, 13 bp, Artificial Sequence
  synthetic sequence
catgctgacgatg

SEQ ID NO: 14595 - DNA, 13 bp, Artificial Sequence
  synthetic sequence
cttttcgatagga

SEQ ID NO: 14596 - DNA, 13 bp, Artificial Sequence
  synthetic sequence
tcagccaacgcat

SEQ ID NO: 14597 - DNA, 13 bp, Artificial Sequence
  synthetic sequence
gaacggtttcgcc

SEQ ID NO: 14598 - DNA, 13 bp, Artificial Sequence
  synthetic sequence
ctcccgcgtgatc

SEQ ID NO: 14599 - DNA, 13 bp, Artificial Sequence
  synthetic sequence
gcaaggcgttcgc

SEQ ID NO: 14600 - DNA, 13 bp, Artificial Sequence
  synthetic sequence
cttcagttactgc

SEQ ID NO: 14601 - DNA, 13 bp, Artificial Sequence
  synthetic sequence
aggtacacacggc

SEQ ID NO: 14602 - DNA, 13 bp, Artificial Sequence
  synthetic sequence
atgccgccgtcag

SEQ ID NO: 14603 - DNA, 13 bp, Artificial Sequence
  synthetic sequence
ttggcaccggagc

SEQ ID NO: 14604 - DNA, 13 bp, Artificial Sequence
  synthetic sequence
acgcttcgttgct

SEQ ID NO: 14605 - DNA, 13 bp, Artificial Sequence
  synthetic sequence
tgcttgcagaagc

SEQ ID NO: 14606 - DNA, 13 bp, Artificial Sequence
  synthetic sequence
aatacaaccatta

SEQ ID NO: 14607 - DNA, 13 bp, Artificial Sequence
  synthetic sequence
ctgtcgcgctcga

SEQ ID NO: 14608 - DNA, 13 bp, Artificial Sequence
  synthetic sequence
cttaggaaggatg

SEQ ID NO: 14609 - DNA, 13 bp, Artificial Sequence
  synthetic sequence
tgaccctactgaa

SEQ ID NO: 14610 - DNA, 13 bp, Artificial Sequence
  synthetic sequence
tatgtggtaatct

SEQ ID NO: 14611 - DNA, 13 bp, Artificial Sequence
  synthetic sequence
gacaccagcttcg

SEQ ID NO: 14612 - DNA, 13 bp, Artificial Sequence
  synthetic sequence
ggtagtggtgtcg

SEQ ID NO: 14613 - DNA, 13 bp, Artificial Sequence
  synthetic sequence
ccaactcctccat

SEQ ID NO: 14614 - DNA, 13 bp, Artificial Sequence
  synthetic sequence
acaacgtttgctg

SEQ ID NO: 14615 - DNA, 13 bp, Artificial Sequence
  synthetic sequence
cgttgctgcgctt

SEQ ID NO: 14616 - DNA, 13 bp, Artificial Sequence
  synthetic sequence
atagacaatactt

SEQ ID NO: 14617 - DNA, 13 bp, Artificial Sequence
  synthetic sequence
gatccttgcgcaa

SEQ ID NO: 14618 - DNA, 13 bp, Artificial Sequence
  synthetic sequence
caagctttgcact

SEQ ID NO: 14619 - DNA, 13 bp, Artificial Sequence
  synthetic sequence
cagatagttcgcc

SEQ ID NO: 14620 - DNA, 13 bp, Artificial Sequence
  synthetic sequence
actctcgcgagtt

SEQ ID NO: 14621 - DNA, 13 bp, Artificial Sequence
  synthetic sequence
agaaaacaatcag

SEQ ID NO: 14622 - DNA, 13 bp, Artificial Sequence
  synthetic sequence
agatgttgcacgt

SEQ ID NO: 14623 - DNA, 13 bp, Artificial Sequence
  synthetic sequence
ggatatgggcacg

SEQ ID NO: 14624 - DNA, 13 bp, Artificial Sequence
  synthetic sequence
atcgatcacggcg

SEQ ID NO: 14625 - DNA, 13 bp, Artificial Sequence
  synthetic sequence
aatgtgactcaaa

SEQ ID NO: 14626 - DNA, 13 bp, Artificial Sequence
  synthetic sequence
tttaaagcgggca

SEQ ID NO: 14627 - DNA, 13 bp, Artificial Sequence
  synthetic sequence
aaattctgtcgtt

SEQ ID NO: 14628 - DNA, 13 bp, Artificial Sequence
  synthetic sequence
taataaccttgat

SEQ ID NO: 14629 - DNA, 13 bp, Artificial Sequence
  synthetic sequence
gatctttatcatg

SEQ ID NO: 14630 - DNA, 13 bp, Artificial Sequence
  synthetic sequence
atggtggtgatgc

SEQ ID NO: 14631 - DNA, 13 bp, Artificial Sequence
  synthetic sequence
aatgcagtgcggc

SEQ ID NO: 14632 - DNA, 13 bp, Artificial Sequence
  synthetic sequence
ctccaaatggatt

SEQ ID NO: 14633 - DNA, 13 bp, Artificial Sequence
  synthetic sequence
accaccccattcg

SEQ ID NO: 14634 - DNA, 13 bp, Artificial Sequence
  synthetic sequence
atcacttataacc

SEQ ID NO: 14635 - DNA, 13 bp, Artificial Sequence
  synthetic sequence
aagagctcaaaac

SEQ ID NO: 14636 - DNA, 13 bp, Artificial Sequence
  synthetic sequence
gatgtcggcaagg

SEQ ID NO: 14637 - DNA, 13 bp, Artificial Sequence
  synthetic sequence
aatcttattgacc

SEQ ID NO: 14638 - DNA, 13 bp, Artificial Sequence
  synthetic sequence
cgccttcggtcac

SEQ ID NO: 14639 - DNA, 13 bp, Artificial Sequence
  synthetic sequence
tgggaaatggtgg

SEQ ID NO: 14640 - DNA, 13 bp, Artificial Sequence
  synthetic sequence
gccgtcatgctcc

SEQ ID NO: 14641 - DNA, 13 bp, Artificial Sequence
  synthetic sequence
cccagagacgagg

SEQ ID NO: 14642 - DNA, 13 bp, Artificial Sequence
  synthetic sequence
ttcgagccatgct

SEQ ID NO: 14643 - DNA, 13 bp, Artificial Sequence
  synthetic sequence
ctgaagttgaccg

SEQ ID NO: 14644 - DNA, 13 bp, Artificial Sequence
  synthetic sequence
tgtcgctgatggc

SEQ ID NO: 14645 - DNA, 13 bp, Artificial Sequence
  synthetic sequence
ctaatattcccta

SEQ ID NO: 14646 - DNA, 13 bp, Artificial Sequence
  synthetic sequence
cttatggcattac

SEQ ID NO: 14647 - DNA, 13 bp, Artificial Sequence
  synthetic sequence
accttcagatata

SEQ ID NO: 14648 - DNA, 13 bp, Artificial Sequence
  synthetic sequence
ggtctctttatcg

SEQ ID NO: 14649 - DNA, 13 bp, Artificial Sequence
  synthetic sequence
caatagcagtgaa

SEQ ID NO: 14650 - DNA, 13 bp, Artificial Sequence
  synthetic sequence
tggacgtacgtaa

SEQ ID NO: 14651 - DNA, 13 bp, Artificial Sequence
  synthetic sequence
cccgatgtcattc

SEQ ID NO: 14652 - DNA, 13 bp, Artificial Sequence
  synthetic sequence
tgtgtttagaatg

SEQ ID NO: 14653 - DNA, 13 bp, Artificial Sequence
  synthetic sequence
gatgccgctaacg

SEQ ID NO: 14654 - DNA, 13 bp, Artificial Sequence
  synthetic sequence
ggggagtagcagc

SEQ ID NO: 14655 - DNA, 13 bp, Artificial Sequence
  synthetic sequence
catattcctttca

SEQ ID NO: 14656 - DNA, 13 bp, Artificial Sequence
  synthetic sequence
ctggcaacctaca

SEQ ID NO: 14657 - DNA, 13 bp, Artificial Sequence
  synthetic sequence
agtagtcaaccac

SEQ ID NO: 14658 - DNA, 13 bp, Artificial Sequence
  synthetic sequence
tcgtgggatatac

SEQ ID NO: 14659 - DNA, 13 bp, Artificial Sequence
  synthetic sequence
gagaatatctgcc

SEQ ID NO: 14660 - DNA, 13 bp, Artificial Sequence
  synthetic sequence
tgagtattggcgc

SEQ ID NO: 14661 - DNA, 13 bp, Artificial Sequence
  synthetic sequence
tcagcgcctccct

SEQ ID NO: 14662 - DNA, 13 bp, Artificial Sequence
  synthetic sequence
gtgtgattgcagc

SEQ ID NO: 14663 - DNA, 13 bp, Artificial Sequence
  synthetic sequence
cgctaatacgatc

SEQ ID NO: 14664 - DNA, 13 bp, Artificial Sequence
  synthetic sequence
gtaatgtatctgt

SEQ ID NO: 14665 - DNA, 13 bp, Artificial Sequence
  synthetic sequence
atgtaccagggat

SEQ ID NO: 14666 - DNA, 13 bp, Artificial Sequence
  synthetic sequence
gaagagtgcgtag

SEQ ID NO: 14667 - DNA, 13 bp, Artificial Sequence
  synthetic sequence
gctggtgaacagg

SEQ ID NO: 14668 - DNA, 13 bp, Artificial Sequence
  synthetic sequence
ggttcagcgtaag

SEQ ID NO: 14669 - DNA, 13 bp, Artificial Sequence
  synthetic sequence
ttgatgtactttc

SEQ ID NO: 14670 - DNA, 13 bp, Artificial Sequence
  synthetic sequence
gagcgggtgctat

SEQ ID NO: 14671 - DNA, 13 bp, Artificial Sequence
  synthetic sequence
atggtcgccggct

SEQ ID NO: 14672 - DNA, 13 bp, Artificial Sequence
  synthetic sequence
gcgtaccattgtt

SEQ ID NO: 14673 - DNA, 13 bp, Artificial Sequence
  synthetic sequence
tccactcgaaccg

SEQ ID NO: 14674 - DNA, 13 bp, Artificial Sequence
  synthetic sequence
gaccaccacgcac

SEQ ID NO: 14675 - DNA, 13 bp, Artificial Sequence
  synthetic sequence
tccctggcgatcg

SEQ ID NO: 14676 - DNA, 13 bp, Artificial Sequence
  synthetic sequence
tcgtccttgatca

SEQ ID NO: 14677 - DNA, 13 bp, Artificial Sequence
  synthetic sequence
gttcggtgaatat

SEQ ID NO: 14678 - DNA, 13 bp, Artificial Sequence
  synthetic sequence
caccacgcaaaag

SEQ ID NO: 14679 - DNA, 13 bp, Artificial Sequence
  synthetic sequence
tcgcgacctgaaa

SEQ ID NO: 14680 - DNA, 13 bp, Artificial Sequence
  synthetic sequence
cgtcgtgtgcgct

SEQ ID NO: 14681 - DNA, 13 bp, Artificial Sequence
  synthetic sequence
tgaaccatgggga

SEQ ID NO: 14682 - DNA, 13 bp, Artificial Sequence
  synthetic sequence
cagtgagtttatg

SEQ ID NO: 14683 - DNA, 13 bp, Artificial Sequence
  synthetic sequence
aaagcgtcttgcg

SEQ ID NO: 14684 - DNA, 13 bp, Artificial Sequence
  synthetic sequence
atcagtgataaag

SEQ ID NO: 14685 - DNA, 13 bp, Artificial Sequence
  synthetic sequence
agcaatcccgcca

SEQ ID NO: 14686 - DNA, 13 bp, Artificial Sequence
  synthetic sequence
aaaacggcgattt

SEQ ID NO: 14687 - DNA, 13 bp, Artificial Sequence
  synthetic sequence
ttatctggtgatc

SEQ ID NO: 14688 - DNA, 13 bp, Artificial Sequence
  synthetic sequence
tcacggcggattt

SEQ ID NO: 14689 - DNA, 13 bp, Artificial Sequence
  synthetic sequence
agcatcttttact

SEQ ID NO: 14690 - DNA, 13 bp, Artificial Sequence
  synthetic sequence
ttctgtttcaggc

SEQ ID NO: 14691 - DNA, 13 bp, Artificial Sequence
  synthetic sequence
gggtctgctcatt

SEQ ID NO: 14692 - DNA, 13 bp, Artificial Sequence
  synthetic sequence
gacctgcctcatc

SEQ ID NO: 14693 - DNA, 13 bp, Artificial Sequence
  synthetic sequence
tgcgcaatatccg

SEQ ID NO: 14694 - DNA, 13 bp, Artificial Sequence
  synthetic sequence
caaatgtaaagcg

SEQ ID NO: 14695 - DNA, 13 bp, Artificial Sequence
  synthetic sequence
ttagcttcaattc

SEQ ID NO: 14696 - DNA, 13 bp, Artificial Sequence
  synthetic sequence
acagcagactata

SEQ ID NO: 14697 - DNA, 13 bp, Artificial Sequence
  synthetic sequence
gtggtatcacgtg

SEQ ID NO: 14698 - DNA, 13 bp, Artificial Sequence
  synthetic sequence
cttttgagtcaat

SEQ ID NO: 14699 - DNA, 13 bp, Artificial Sequence
  synthetic sequence
ggttacccgcttc

SEQ ID NO: 14700 - DNA, 13 bp, Artificial Sequence
  synthetic sequence
tagaaatcctttg

SEQ ID NO: 14701 - DNA, 13 bp, Artificial Sequence
  synthetic sequence
accaattgttcca

SEQ ID NO: 14702 - DNA, 13 bp, Artificial Sequence
  synthetic sequence
cttcatccatcgc

SEQ ID NO: 14703 - DNA, 13 bp, Artificial Sequence
  synthetic sequence
cttgaagaaattc

SEQ ID NO: 14704 - DNA, 13 bp, Artificial Sequence
  synthetic sequence
cgctcatggagct

SEQ ID NO: 14705 - DNA, 13 bp, Artificial Sequence
  synthetic sequence
gtttattggctca

SEQ ID NO: 14706 - DNA, 13 bp, Artificial Sequence
  synthetic sequence
caacggaagcgtt

SEQ ID NO: 14707 - DNA, 13 bp, Artificial Sequence
  synthetic sequence
gatacatccccgg

SEQ ID NO: 14708 - DNA, 13 bp, Artificial Sequence
  synthetic sequence
gtagtgccactgg

SEQ ID NO: 14709 - DNA, 13 bp, Artificial Sequence
  synthetic sequence
tgtttccttttgc

SEQ ID NO: 14710 - DNA, 13 bp, Artificial Sequence
  synthetic sequence
ggacaaggcggta

SEQ ID NO: 14711 - DNA, 13 bp, Artificial Sequence
  synthetic sequence
aacctcggcgaga

SEQ ID NO: 14712 - DNA, 13 bp, Artificial Sequence
  synthetic sequence
ctctatatcttca

SEQ ID NO: 14713 - DNA, 13 bp, Artificial Sequence
  synthetic sequence
tgcctatagagta

SEQ ID NO: 14714 - DNA, 13 bp, Artificial Sequence
  synthetic sequence
gacgccgaactcg

SEQ ID NO: 14715 - DNA, 13 bp, Artificial Sequence
  synthetic sequence
ctcattgagcacc

SEQ ID NO: 14716 - DNA, 13 bp, Artificial Sequence
  synthetic sequence
tcgtggtattcac

SEQ ID NO: 14717 - DNA, 13 bp, Artificial Sequence
  synthetic sequence
tacagcaactcga

SEQ ID NO: 14718 - DNA, 13 bp, Artificial Sequence
  synthetic sequence
cagcgggaactgg

SEQ ID NO: 14719 - DNA, 13 bp, Artificial Sequence
  synthetic sequence
gtatgaccttgga

SEQ ID NO: 14720 - DNA, 13 bp, Artificial Sequence
  synthetic sequence
tggttttgccgga

SEQ ID NO: 14721 - DNA, 13 bp, Artificial Sequence
  synthetic sequence
aagaggaaagttc

SEQ ID NO: 14722 - DNA, 13 bp, Artificial Sequence
  synthetic sequence
aaaatgtgttttc

SEQ ID NO: 14723 - DNA, 13 bp, Artificial Sequence
  synthetic sequence
acaacgtctggac

SEQ ID NO: 14724 - DNA, 13 bp, Artificial Sequence
  synthetic sequence
taatcgttataac

SEQ ID NO: 14725 - DNA, 13 bp, Artificial Sequence
  synthetic sequence
tcgaggccaccct

SEQ ID NO: 14726 - DNA, 13 bp, Artificial Sequence
  synthetic sequence
tgccattcttcga

SEQ ID NO: 14727 - DNA, 13 bp, Artificial Sequence
  synthetic sequence
cggcttgagcgct

SEQ ID NO: 14728 - DNA, 13 bp, Artificial Sequence
  synthetic sequence
cttgataccttag

SEQ ID NO: 14729 - DNA, 13 bp, Artificial Sequence
  synthetic sequence
agtatgaaatact

SEQ ID NO: 14730 - DNA, 13 bp, Artificial Sequence
  synthetic sequence
tatgtgggagaaa

SEQ ID NO: 14731 - DNA, 13 bp, Artificial Sequence
  synthetic sequence
tcgtggtaatgcc

SEQ ID NO: 14732 - DNA, 13 bp, Artificial Sequence
  synthetic sequence
gcagtctttgtgc

SEQ ID NO: 14733 - DNA, 13 bp, Artificial Sequence
  synthetic sequence
tctcgggcatcca

SEQ ID NO: 14734 - DNA, 13 bp, Artificial Sequence
  synthetic sequence
acttctataaggt

SEQ ID NO: 14735 - DNA, 13 bp, Artificial Sequence
  synthetic sequence
gtcaccattgttg

SEQ ID NO: 14736 - DNA, 13 bp, Artificial Sequence
  synthetic sequence
gaacgtcgaaagc

SEQ ID NO: 14737 - DNA, 13 bp, Artificial Sequence
  synthetic sequence
tcctgatcgccag

SEQ ID NO: 14738 - DNA, 13 bp, Artificial Sequence
  synthetic sequence
tcatctggaaatg

SEQ ID NO: 14739 - DNA, 13 bp, Artificial Sequence
  synthetic sequence
gctggtattagct

SEQ ID NO: 14740 - DNA, 13 bp, Artificial Sequence
  synthetic sequence
gcgaagcatcctg

SEQ ID NO: 14741 - DNA, 13 bp, Artificial Sequence
  synthetic sequence
tctacagccttga

SEQ ID NO: 14742 - DNA, 13 bp, Artificial Sequence
  synthetic sequence
tcggcatcgtgca

SEQ ID NO: 14743 - DNA, 13 bp, Artificial Sequence
  synthetic sequence
acatcgggtattt

SEQ ID NO: 14744 - DNA, 13 bp, Artificial Sequence
  synthetic sequence
cttttcgtttcat

SEQ ID NO: 14745 - DNA, 13 bp, Artificial Sequence
  synthetic sequence
ggtctggctgcta

SEQ ID NO: 14746 - DNA, 13 bp, Artificial Sequence
  synthetic sequence
cgatgacctggac

SEQ ID NO: 14747 - DNA, 13 bp, Artificial Sequence
  synthetic sequence
aagtatggtctat

SEQ ID NO: 14748 - DNA, 13 bp, Artificial Sequence
  synthetic sequence
acaaacatcggat

SEQ ID NO: 14749 - DNA, 13 bp, Artificial Sequence
  synthetic sequence
ccaccacaaagaa

SEQ ID NO: 14750 - DNA, 13 bp, Artificial Sequence
  synthetic sequence
ggccatgacggtg

SEQ ID NO: 14751 - DNA, 13 bp, Artificial Sequence
  synthetic sequence
tggccgaggcgat

SEQ ID NO: 14752 - DNA, 13 bp, Artificial Sequence
  synthetic sequence
cgaaagcccattc

SEQ ID NO: 14753 - DNA, 13 bp, Artificial Sequence
  synthetic sequence
ttccagcatccgg

SEQ ID NO: 14754 - DNA, 13 bp, Artificial Sequence
  synthetic sequence
tcaggacaatgct

SEQ ID NO: 14755 - DNA, 13 bp, Artificial Sequence
  synthetic sequence
tgttcaatctact

SEQ ID NO: 14756 - DNA, 13 bp, Artificial Sequence
  synthetic sequence
gtcagcagggtct

SEQ ID NO: 14757 - DNA, 13 bp, Artificial Sequence
  synthetic sequence
tacctagctatag

SEQ ID NO: 14758 - DNA, 13 bp, Artificial Sequence
  synthetic sequence
agatagataaggc

SEQ ID NO: 14759 - DNA, 13 bp, Artificial Sequence
  synthetic sequence
accgacagagcgg

SEQ ID NO: 14760 - DNA, 13 bp, Artificial Sequence
  synthetic sequence
atccaaagcgcac

SEQ ID NO: 14761 - DNA, 13 bp, Artificial Sequence
  synthetic sequence
gcaacgatgtctg

SEQ ID NO: 14762 - DNA, 13 bp, Artificial Sequence
  synthetic sequence
agcatcccgacct

SEQ ID NO: 14763 - DNA, 13 bp, Artificial Sequence
  synthetic sequence
gacgtttatcccc

SEQ ID NO: 14764 - DNA, 13 bp, Artificial Sequence
  synthetic sequence
tttgggtcaagtt

SEQ ID NO: 14765 - DNA, 13 bp, Artificial Sequence
  synthetic sequence
aagatttcttgtt

SEQ ID NO: 14766 - DNA, 13 bp, Artificial Sequence
  synthetic sequence
agggcttttactg

SEQ ID NO: 14767 - DNA, 13 bp, Artificial Sequence
  synthetic sequence
tcggccttctgcg

SEQ ID NO: 14768 - DNA, 13 bp, Artificial Sequence
  synthetic sequence
ttctcacggaatc

SEQ ID NO: 14769 - DNA, 13 bp, Artificial Sequence
  synthetic sequence
caggcgcgacgaa

SEQ ID NO: 14770 - DNA, 13 bp, Artificial Sequence
  synthetic sequence
agactatcgttaa

SEQ ID NO: 14771 - DNA, 13 bp, Artificial Sequence
  synthetic sequence
acctatctgcagg

SEQ ID NO: 14772 - DNA, 13 bp, Artificial Sequence
  synthetic sequence
atgctgtccgtgt

SEQ ID NO: 14773 - DNA, 13 bp, Artificial Sequence
  synthetic sequence
atctgtttagcta

SEQ ID NO: 14774 - DNA, 13 bp, Artificial Sequence
  synthetic sequence
gttcgctcccgct

SEQ ID NO: 14775 - DNA, 13 bp, Artificial Sequence
  synthetic sequence
tccgcgacaatgg

SEQ ID NO: 14776 - DNA, 13 bp, Artificial Sequence
  synthetic sequence
cgaataccgttcc

SEQ ID NO: 14777 - DNA, 13 bp, Artificial Sequence
  synthetic sequence
ccatgccgatggg

SEQ ID NO: 14778 - DNA, 13 bp, Artificial Sequence
  synthetic sequence
aatgcgcagttgc

SEQ ID NO: 14779 - DNA, 13 bp, Artificial Sequence
  synthetic sequence
ttcctccaatcgg

SEQ ID NO: 14780 - DNA, 13 bp, Artificial Sequence
  synthetic sequence
gccatctgattga

SEQ ID NO: 14781 - DNA, 13 bp, Artificial Sequence
  synthetic sequence
taaacccgctgtc

SEQ ID NO: 14782 - DNA, 13 bp, Artificial Sequence
  synthetic sequence
atcgtaaaagtct

SEQ ID NO: 14783 - DNA, 13 bp, Artificial Sequence
  synthetic sequence
atgttcaatatca

SEQ ID NO: 14784 - DNA, 13 bp, Artificial Sequence
  synthetic sequence
ctcaactatcaga

SEQ ID NO: 14785 - DNA, 13 bp, Artificial Sequence
  synthetic sequence
tcaatgtcatttt

SEQ ID NO: 14786 - DNA, 13 bp, Artificial Sequence
  synthetic sequence
gcagcgtgaggat

SEQ ID NO: 14787 - DNA, 13 bp, Artificial Sequence
  synthetic sequence
cgttaagctgctg

SEQ ID NO: 14788 - DNA, 13 bp, Artificial Sequence
  synthetic sequence
ggtaactatattt

SEQ ID NO: 14789 - DNA, 13 bp, Artificial Sequence
  synthetic sequence
ttcccggtggtat

SEQ ID NO: 14790 - DNA, 13 bp, Artificial Sequence
  synthetic sequence
tgtccatgcaagc

SEQ ID NO: 14791 - DNA, 13 bp, Artificial Sequence
  synthetic sequence
tatctccgggatc

SEQ ID NO: 14792 - DNA, 13 bp, Artificial Sequence
  synthetic sequence
gagaacccaaagg

SEQ ID NO: 14793 - DNA, 13 bp, Artificial Sequence
  synthetic sequence
aacctcaaggtgt

SEQ ID NO: 14794 - DNA, 13 bp, Artificial Sequence
  synthetic sequence
tccggcacgttgc

SEQ ID NO: 14795 - DNA, 13 bp, Artificial Sequence
  synthetic sequence
atattccttacca

SEQ ID NO: 14796 - DNA, 13 bp, Artificial Sequence
  synthetic sequence
aatctacgctgat

SEQ ID NO: 14797 - DNA, 13 bp, Artificial Sequence
  synthetic sequence
ggcgggatcaacc

SEQ ID NO: 14798 - DNA, 13 bp, Artificial Sequence
  synthetic sequence
cgaggccatcgag

SEQ ID NO: 14799 - DNA, 13 bp, Artificial Sequence
  synthetic sequence
aacatgatattgc

SEQ ID NO: 14800 - DNA, 13 bp, Artificial Sequence
  synthetic sequence
agtaagtcaacaa

SEQ ID NO: 14801 - DNA, 13 bp, Artificial Sequence
  synthetic sequence
gccacggtcggtt

SEQ ID NO: 14802 - DNA, 13 bp, Artificial Sequence
  synthetic sequence
ggtcttcgtaagc

SEQ ID NO: 14803 - DNA, 13 bp, Artificial Sequence
  synthetic sequence
attgaccgagcat

SEQ ID NO: 14804 - DNA, 13 bp, Artificial Sequence
  synthetic sequence
atagtgtggcata

SEQ ID NO: 14805 - DNA, 13 bp, Artificial Sequence
  synthetic sequence
ggaacaagcaata

SEQ ID NO: 14806 - DNA, 13 bp, Artificial Sequence
  synthetic sequence
agttcagggactt

SEQ ID NO: 14807 - DNA, 13 bp, Artificial Sequence
  synthetic sequence
attatcagttaga

SEQ ID NO: 14808 - DNA, 13 bp, Artificial Sequence
  synthetic sequence
ctcctgtctcctt

SEQ ID NO: 14809 - DNA, 13 bp, Artificial Sequence
  synthetic sequence
cagtcatcccact

SEQ ID NO: 14810 - DNA, 13 bp, Artificial Sequence
  synthetic sequence
atcgcagggaaca

SEQ ID NO: 14811 - DNA, 13 bp, Artificial Sequence
  synthetic sequence
atcgacaacacgg

SEQ ID NO: 14812 - DNA, 13 bp, Artificial Sequence
  synthetic sequence
gaccttcctcctc

SEQ ID NO: 14813 - DNA, 13 bp, Artificial Sequence
  synthetic sequence
tgcggcgcaattg

SEQ ID NO: 14814 - DNA, 13 bp, Artificial Sequence
  synthetic sequence
agcttccaggccg

SEQ ID NO: 14815 - DNA, 13 bp, Artificial Sequence
  synthetic sequence
gcaattcggggag

SEQ ID NO: 14816 - DNA, 13 bp, Artificial Sequence
  synthetic sequence
agaacatctacga

SEQ ID NO: 14817 - DNA, 13 bp, Artificial Sequence
  synthetic sequence
aaagcgaaactgg

SEQ ID NO: 14818 - DNA, 13 bp, Artificial Sequence
  synthetic sequence
ccagcggcacgaa

SEQ ID NO: 14819 - DNA, 13 bp, Artificial Sequence
  synthetic sequence
gcggccgtagttt

SEQ ID NO: 14820 - DNA, 13 bp, Artificial Sequence
  synthetic sequence
gaagcctgctccg

SEQ ID NO: 14821 - DNA, 13 bp, Artificial Sequence
  synthetic sequence
cttgtggtgcctc

SEQ ID NO: 14822 - DNA, 13 bp, Artificial Sequence
  synthetic sequence
caaggcgctattt

SEQ ID NO: 14823 - DNA, 13 bp, Artificial Sequence
  synthetic sequence
ggatcgcttctcg

SEQ ID NO: 14824 - DNA, 13 bp, Artificial Sequence
  synthetic sequence
accaccatcgaca

SEQ ID NO: 14825 - DNA, 13 bp, Artificial Sequence
  synthetic sequence
gctgaagttggat

SEQ ID NO: 14826 - DNA, 13 bp, Artificial Sequence
  synthetic sequence
ccaacaattggtt

SEQ ID NO: 14827 - DNA, 13 bp, Artificial Sequence
  synthetic sequence
cgaggaagttggg

SEQ ID NO: 14828 - DNA, 13 bp, Artificial Sequence
  synthetic sequence
ccctcgccaatgc

SEQ ID NO: 14829 - DNA, 13 bp, Artificial Sequence
  synthetic sequence
ctggatgcggcca

SEQ ID NO: 14830 - DNA, 13 bp, Artificial Sequence
  synthetic sequence
gttatgtggtggc

SEQ ID NO: 14831 - DNA, 13 bp, Artificial Sequence
  synthetic sequence
acgcgcgtcaacc

SEQ ID NO: 14832 - DNA, 13 bp, Artificial Sequence
  synthetic sequence
tttaggtgtggtt

SEQ ID NO: 14833 - DNA, 13 bp, Artificial Sequence
  synthetic sequence
atatcggtgatta

SEQ ID NO: 14834 - DNA, 13 bp, Artificial Sequence
  synthetic sequence
acttcaagcagtg

SEQ ID NO: 14835 - DNA, 13 bp, Artificial Sequence
  synthetic sequence
accccagcatagg

SEQ ID NO: 14836 - DNA, 13 bp, Artificial Sequence
  synthetic sequence
gcccgaaagtttt

SEQ ID NO: 14837 - DNA, 13 bp, Artificial Sequence
  synthetic sequence
cgtcaatgggcct

SEQ ID NO: 14838 - DNA, 13 bp, Artificial Sequence
  synthetic sequence
aaatcaactcaga

SEQ ID NO: 14839 - DNA, 13 bp, Artificial Sequence
  synthetic sequence
gccgtcacgaaca

SEQ ID NO: 14840 - DNA, 13 bp, Artificial Sequence
  synthetic sequence
gcatgaccgtcat

SEQ ID NO: 14841 - DNA, 13 bp, Artificial Sequence
  synthetic sequence
aaacaaccagatt

SEQ ID NO: 14842 - DNA, 13 bp, Artificial Sequence
  synthetic sequence
caggtaaccaatc

SEQ ID NO: 14843 - DNA, 13 bp, Artificial Sequence
  synthetic sequence
gtgcttttcaagc

SEQ ID NO: 14844 - DNA, 13 bp, Artificial Sequence
  synthetic sequence
gtgagaatgttac

SEQ ID NO: 14845 - DNA, 13 bp, Artificial Sequence
  synthetic sequence
caaacactggaaa

SEQ ID NO: 14846 - DNA, 13 bp, Artificial Sequence
  synthetic sequence
cacaggattgagt

SEQ ID NO: 14847 - DNA, 13 bp, Artificial Sequence
  synthetic sequence
tcaatggttcgtc

SEQ ID NO: 14848 - DNA, 13 bp, Artificial Sequence
  synthetic sequence
gcgccgcttcgtt

SEQ ID NO: 14849 - DNA, 13 bp, Artificial Sequence
  synthetic sequence
cattgatgaaggt

SEQ ID NO: 14850 - DNA, 13 bp, Artificial Sequence
  synthetic sequence
acttttagttgga

SEQ ID NO: 14851 - DNA, 13 bp, Artificial Sequence
  synthetic sequence
gttacagcttatg

SEQ ID NO: 14852 - DNA, 13 bp, Artificial Sequence
  synthetic sequence
gccacattggagc

SEQ ID NO: 14853 - DNA, 13 bp, Artificial Sequence
  synthetic sequence
cttcctcagttag

SEQ ID NO: 14854 - DNA, 13 bp, Artificial Sequence
  synthetic sequence
ctaacagtgcaga

SEQ ID NO: 14855 - DNA, 13 bp, Artificial Sequence
  synthetic sequence
cttcgcttttacg

SEQ ID NO: 14856 - DNA, 13 bp, Artificial Sequence
  synthetic sequence
gatatccaaggat

SEQ ID NO: 14857 - DNA, 13 bp, Artificial Sequence
  synthetic sequence
tactgtgttgatc

SEQ ID NO: 14858 - DNA, 13 bp, Artificial Sequence
  synthetic sequence
ataagacgtatcg

SEQ ID NO: 14859 - DNA, 13 bp, Artificial Sequence
  synthetic sequence
ggaaataatcagc

SEQ ID NO: 14860 - DNA, 13 bp, Artificial Sequence
  synthetic sequence
tccatcgacggta

SEQ ID NO: 14861 - DNA, 13 bp, Artificial Sequence
  synthetic sequence
cgatgccttgccc

SEQ ID NO: 14862 - DNA, 13 bp, Artificial Sequence
  synthetic sequence
caaacatgaaagc

SEQ ID NO: 14863 - DNA, 13 bp, Artificial Sequence
  synthetic sequence
ttggcgatgcatc

SEQ ID NO: 14864 - DNA, 13 bp, Artificial Sequence
  synthetic sequence
agcatccggatca

SEQ ID NO: 14865 - DNA, 13 bp, Artificial Sequence
  synthetic sequence
aggcacagaacac

SEQ ID NO: 14866 - DNA, 13 bp, Artificial Sequence
  synthetic sequence
tgctcgctggtct

SEQ ID NO: 14867 - DNA, 13 bp, Artificial Sequence
  synthetic sequence
ggcggttgaaggg

SEQ ID NO: 14868 - DNA, 13 bp, Artificial Sequence
  synthetic sequence
taattcttcaacg

SEQ ID NO: 14869 - DNA, 13 bp, Artificial Sequence
  synthetic sequence
cacgccgattaac

SEQ ID NO: 14870 - DNA, 13 bp, Artificial Sequence
  synthetic sequence
ctcttgcacactc

SEQ ID NO: 14871 - DNA, 13 bp, Artificial Sequence
  synthetic sequence
cttccggcaccga

SEQ ID NO: 14872 - DNA, 13 bp, Artificial Sequence
  synthetic sequence
ctgagcctgacgg

SEQ ID NO: 14873 - DNA, 13 bp, Artificial Sequence
  synthetic sequence
ttgaagtgttggc

SEQ ID NO: 14874 - DNA, 13 bp, Artificial Sequence
  synthetic sequence
tcagcacgcccag

SEQ ID NO: 14875 - DNA, 13 bp, Artificial Sequence
  synthetic sequence
ctgccgccgatct

SEQ ID NO: 14876 - DNA, 13 bp, Artificial Sequence
  synthetic sequence
ctgaacattattc

SEQ ID NO: 14877 - DNA, 13 bp, Artificial Sequence
  synthetic sequence
agagttgatggcg

SEQ ID NO: 14878 - DNA, 13 bp, Artificial Sequence
  synthetic sequence
tgttgcgtttcgt

SEQ ID NO: 14879 - DNA, 13 bp, Artificial Sequence
  synthetic sequence
acggttttggttt

SEQ ID NO: 14880 - DNA, 13 bp, Artificial Sequence
  synthetic sequence
cacaatgggtatc

SEQ ID NO: 14881 - DNA, 13 bp, Artificial Sequence
  synthetic sequence
ggtgtggctttgg

SEQ ID NO: 14882 - DNA, 13 bp, Artificial Sequence
  synthetic sequence
tttggccgatagc

SEQ ID NO: 14883 - DNA, 13 bp, Artificial Sequence
  synthetic sequence
gaggatattgggt

SEQ ID NO: 14884 - DNA, 13 bp, Artificial Sequence
  synthetic sequence
caagcgcttctct

SEQ ID NO: 14885 - DNA, 13 bp, Artificial Sequence
  synthetic sequence
tttgtgaagctgt

SEQ ID NO: 14886 - DNA, 13 bp, Artificial Sequence
  synthetic sequence
atccagaccgcta

SEQ ID NO: 14887 - DNA, 13 bp, Artificial Sequence
  synthetic sequence
ttcgatgctgtcc

SEQ ID NO: 14888 - DNA, 13 bp, Artificial Sequence
  synthetic sequence
attccagccttcc

SEQ ID NO: 14889 - DNA, 13 bp, Artificial Sequence
  synthetic sequence
catcaaggtctca

SEQ ID NO: 14890 - DNA, 13 bp, Artificial Sequence
  synthetic sequence
tggtggtagtgcg

SEQ ID NO: 14891 - DNA, 13 bp, Artificial Sequence
  synthetic sequence
aatggaaatacta

SEQ ID NO: 14892 - DNA, 13 bp, Artificial Sequence
  synthetic sequence
agcacgacaatag

SEQ ID NO: 14893 - DNA, 13 bp, Artificial Sequence
  synthetic sequence
gctagttaacgat

SEQ ID NO: 14894 - DNA, 13 bp, Artificial Sequence
  synthetic sequence
aggtacgcgaccg

SEQ ID NO: 14895 - DNA, 13 bp, Artificial Sequence
  synthetic sequence
ggagtactactcc

SEQ ID NO: 14896 - DNA, 13 bp, Artificial Sequence
  synthetic sequence
atgaaaacgaaca

SEQ ID NO: 14897 - DNA, 13 bp, Artificial Sequence
  synthetic sequence
ccttcggcggtag

SEQ ID NO: 14898 - DNA, 13 bp, Artificial Sequence
  synthetic sequence
agccggaattctg

SEQ ID NO: 14899 - DNA, 13 bp, Artificial Sequence
  synthetic sequence
cgtttgattatat

SEQ ID NO: 14900 - DNA, 13 bp, Artificial Sequence
  synthetic sequence
cacccacaacttg

SEQ ID NO: 14901 - DNA, 13 bp, Artificial Sequence
  synthetic sequence
agcgctacgcaac

SEQ ID NO: 14902 - DNA, 13 bp, Artificial Sequence
  synthetic sequence
aactggcagatgc

SEQ ID NO: 14903 - DNA, 13 bp, Artificial Sequence
  synthetic sequence
taaagtcgcttag

SEQ ID NO: 14904 - DNA, 13 bp, Artificial Sequence
  synthetic sequence
ggcagtcgaagag

SEQ ID NO: 14905 - DNA, 13 bp, Artificial Sequence
  synthetic sequence
accctgctgccca

SEQ ID NO: 14906 - DNA, 13 bp, Artificial Sequence
  synthetic sequence
gaaagtgccctac

SEQ ID NO: 14907 - DNA, 13 bp, Artificial Sequence
  synthetic sequence
acaccctggtgaa

SEQ ID NO: 14908 - DNA, 13 bp, Artificial Sequence
  synthetic sequence
tgaagaacacctt

SEQ ID NO: 14909 - DNA, 13 bp, Artificial Sequence
  synthetic sequence
caggtttagtcat

SEQ ID NO: 14910 - DNA, 13 bp, Artificial Sequence
  synthetic sequence
gggaggatggtgc

SEQ ID NO: 14911 - DNA, 13 bp, Artificial Sequence
  synthetic sequence
gatttccctcgcc

SEQ ID NO: 14912 - DNA, 13 bp, Artificial Sequence
  synthetic sequence
aagttttgtctgg

SEQ ID NO: 14913 - DNA, 13 bp, Artificial Sequence
  synthetic sequence
aacggattcttca

SEQ ID NO: 14914 - DNA, 13 bp, Artificial Sequence
  synthetic sequence
tgcagagaaaagt

SEQ ID NO: 14915 - DNA, 13 bp, Artificial Sequence
  synthetic sequence
agtattactgcag

SEQ ID NO: 14916 - DNA, 13 bp, Artificial Sequence
  synthetic sequence
ttggaggaaattc

SEQ ID NO: 14917 - DNA, 13 bp, Artificial Sequence
  synthetic sequence
atcagcatcaaag

SEQ ID NO: 14918 - DNA, 13 bp, Artificial Sequence
  synthetic sequence
gcggaaggcaata

SEQ ID NO: 14919 - DNA, 13 bp, Artificial Sequence
  synthetic sequence
tcggagaagatgg

SEQ ID NO: 14920 - DNA, 13 bp, Artificial Sequence
  synthetic sequence
tggcggaacgctc

SEQ ID NO: 14921 - DNA, 13 bp, Artificial Sequence
  synthetic sequence
aggcgtcccaact

SEQ ID NO: 14922 - DNA, 13 bp, Artificial Sequence
  synthetic sequence
agacgaaatggag

SEQ ID NO: 14923 - DNA, 13 bp, Artificial Sequence
  synthetic sequence
ttcagctggattt

SEQ ID NO: 14924 - DNA, 13 bp, Artificial Sequence
  synthetic sequence
gaatcaggtcatc

SEQ ID NO: 14925 - DNA, 13 bp, Artificial Sequence
  synthetic sequence
acgctggtcaagg

SEQ ID NO: 14926 - DNA, 13 bp, Artificial Sequence
  synthetic sequence
ctaatcctaatct

SEQ ID NO: 14927 - DNA, 13 bp, Artificial Sequence
  synthetic sequence
tcatggatggcga

SEQ ID NO: 14928 - DNA, 13 bp, Artificial Sequence
  synthetic sequence
tgattggattaaa

SEQ ID NO: 14929 - DNA, 13 bp, Artificial Sequence
  synthetic sequence
tgagcaatttgat

SEQ ID NO: 14930 - DNA, 13 bp, Artificial Sequence
  synthetic sequence
gtggctcgttggc

SEQ ID NO: 14931 - DNA, 13 bp, Artificial Sequence
  synthetic sequence
ctaccagggaccc

SEQ ID NO: 14932 - DNA, 13 bp, Artificial Sequence
  synthetic sequence
gcagttccattga

SEQ ID NO: 14933 - DNA, 13 bp, Artificial Sequence
  synthetic sequence
tagctctgcatga

SEQ ID NO: 14934 - DNA, 13 bp, Artificial Sequence
  synthetic sequence
agctaggatcggt

SEQ ID NO: 14935 - DNA, 13 bp, Artificial Sequence
  synthetic sequence
gaaaagcacctta

SEQ ID NO: 14936 - DNA, 13 bp, Artificial Sequence
  synthetic sequence
gtaggaagcaata

SEQ ID NO: 14937 - DNA, 13 bp, Artificial Sequence
  synthetic sequence
cctttgaagatgg

SEQ ID NO: 14938 - DNA, 13 bp, Artificial Sequence
  synthetic sequence
aaccaagatcaaa

SEQ ID NO: 14939 - DNA, 13 bp, Artificial Sequence
  synthetic sequence
ggcgaaggacaac

SEQ ID NO: 14940 - DNA, 13 bp, Artificial Sequence
  synthetic sequence
ctggcgcgtactc

SEQ ID NO: 14941 - DNA, 13 bp, Artificial Sequence
  synthetic sequence
ccgcacatagcac

SEQ ID NO: 14942 - DNA, 13 bp, Artificial Sequence
  synthetic sequence
caggtttactgcg

SEQ ID NO: 14943 - DNA, 13 bp, Artificial Sequence
  synthetic sequence
gggctaaattgcc

SEQ ID NO: 14944 - DNA, 13 bp, Artificial Sequence
  synthetic sequence
gattcatcaacat

SEQ ID NO: 14945 - DNA, 13 bp, Artificial Sequence
  synthetic sequence
gacgcttgctgct

SEQ ID NO: 14946 - DNA, 13 bp, Artificial Sequence
  synthetic sequence
gttgctgctgctc

SEQ ID NO: 14947 - DNA, 13 bp, Artificial Sequence
  synthetic sequence
ggatctagaatat

SEQ ID NO: 14948 - DNA, 13 bp, Artificial Sequence
  synthetic sequence
ccttggtcagcac

SEQ ID NO: 14949 - DNA, 13 bp, Artificial Sequence
  synthetic sequence
gggttgggcttcg

SEQ ID NO: 14950 - DNA, 13 bp, Artificial Sequence
  synthetic sequence
aatccacatcggc

SEQ ID NO: 14951 - DNA, 13 bp, Artificial Sequence
  synthetic sequence
tgtcctgcgccac

SEQ ID NO: 14952 - DNA, 13 bp, Artificial Sequence
  synthetic sequence
cgctctggagtga

SEQ ID NO: 14953 - DNA, 13 bp, Artificial Sequence
  synthetic sequence
cttcagcgatgaa

SEQ ID NO: 14954 - DNA, 13 bp, Artificial Sequence
  synthetic sequence
ccgaccaacattg

SEQ ID NO: 14955 - DNA, 13 bp, Artificial Sequence
  synthetic sequence
tcgcgttaagcgg

SEQ ID NO: 14956 - DNA, 13 bp, Artificial Sequence
  synthetic sequence
atcgcgcgctcac

SEQ ID NO: 14957 - DNA, 13 bp, Artificial Sequence
  synthetic sequence
caatcagtaatgc

SEQ ID NO: 14958 - DNA, 13 bp, Artificial Sequence
  synthetic sequence
gtatattggttgt

SEQ ID NO: 14959 - DNA, 13 bp, Artificial Sequence
  synthetic sequence
ctcggcaagatgc

SEQ ID NO: 14960 - DNA, 13 bp, Artificial Sequence
  synthetic sequence
aagaattaattgc

SEQ ID NO: 14961 - DNA, 13 bp, Artificial Sequence
  synthetic sequence
cactcagttcgcc

SEQ ID NO: 14962 - DNA, 13 bp, Artificial Sequence
  synthetic sequence
catggtgtcgaac

SEQ ID NO: 14963 - DNA, 13 bp, Artificial Sequence
  synthetic sequence
ttttcaggcagcg

SEQ ID NO: 14964 - DNA, 13 bp, Artificial Sequence
  synthetic sequence
tggcgaactcgac

SEQ ID NO: 14965 - DNA, 13 bp, Artificial Sequence
  synthetic sequence
tatgacgatagca

SEQ ID NO: 14966 - DNA, 13 bp, Artificial Sequence
  synthetic sequence
catgcagaactcg

SEQ ID NO: 14967 - DNA, 13 bp, Artificial Sequence
  synthetic sequence
tgtttcttcaact

SEQ ID NO: 14968 - DNA, 13 bp, Artificial Sequence
  synthetic sequence
gacgagctggcca

SEQ ID NO: 14969 - DNA, 13 bp, Artificial Sequence
  synthetic sequence
tgttgcaacgcct

SEQ ID NO: 14970 - DNA, 13 bp, Artificial Sequence
  synthetic sequence
ctgtcggcgaacc

SEQ ID NO: 14971 - DNA, 13 bp, Artificial Sequence
  synthetic sequence
cacgcaaaatttt

SEQ ID NO: 14972 - DNA, 13 bp, Artificial Sequence
  synthetic sequence
ttcgaaccgctat

SEQ ID NO: 14973 - DNA, 13 bp, Artificial Sequence
  synthetic sequence
ttcctggttctct

SEQ ID NO: 14974 - DNA, 13 bp, Artificial Sequence
  synthetic sequence
tgaatgcttcaag

SEQ ID NO: 14975 - DNA, 13 bp, Artificial Sequence
  synthetic sequence
gttcgtggctgat

SEQ ID NO: 14976 - DNA, 13 bp, Artificial Sequence
  synthetic sequence
aatattagtactg

SEQ ID NO: 14977 - DNA, 13 bp, Artificial Sequence
  synthetic sequence
aaattgttgtcgg

SEQ ID NO: 14978 - DNA, 13 bp, Artificial Sequence
  synthetic sequence
acgatgttgtctc

SEQ ID NO: 14979 - DNA, 13 bp, Artificial Sequence
  synthetic sequence
gggtgtcaggctg

SEQ ID NO: 14980 - DNA, 13 bp, Artificial Sequence
  synthetic sequence
tgttgcaacagct

SEQ ID NO: 14981 - DNA, 13 bp, Artificial Sequence
  synthetic sequence
tggtatcagcctg

SEQ ID NO: 14982 - DNA, 13 bp, Artificial Sequence
  synthetic sequence
gtacaggttcaaa

SEQ ID NO: 14983 - DNA, 13 bp, Artificial Sequence
  synthetic sequence
tgctgggtcacgg

SEQ ID NO: 14984 - DNA, 13 bp, Artificial Sequence
  synthetic sequence
gtacacgtttcgc

SEQ ID NO: 14985 - DNA, 13 bp, Artificial Sequence
  synthetic sequence
accagactcgtcg

SEQ ID NO: 14986 - DNA, 13 bp, Artificial Sequence
  synthetic sequence
tacaagtactttt

SEQ ID NO: 14987 - DNA, 13 bp, Artificial Sequence
  synthetic sequence
caatgatgaaaga

SEQ ID NO: 14988 - DNA, 13 bp, Artificial Sequence
  synthetic sequence
ggcttaatacaaa

SEQ ID NO: 14989 - DNA, 13 bp, Artificial Sequence
  synthetic sequence
atcaattgatgac

SEQ ID NO: 14990 - DNA, 13 bp, Artificial Sequence
  synthetic sequence
ccttctacaattt

SEQ ID NO: 14991 - DNA, 13 bp, Artificial Sequence
  synthetic sequence
taccaccgtgacc

SEQ ID NO: 14992 - DNA, 13 bp, Artificial Sequence
  synthetic sequence
gaacgaccagatt

SEQ ID NO: 14993 - DNA, 13 bp, Artificial Sequence
  synthetic sequence
tactttgtctatt

SEQ ID NO: 14994 - DNA, 13 bp, Artificial Sequence
  synthetic sequence
caccaggtgaaat

SEQ ID NO: 14995 - DNA, 13 bp, Artificial Sequence
  synthetic sequence
gcagaacttgaaa

SEQ ID NO: 14996 - DNA, 13 bp, Artificial Sequence
  synthetic sequence
agtagtcgcttca

SEQ ID NO: 14997 - DNA, 13 bp, Artificial Sequence
  synthetic sequence
tacttaacgagtg

SEQ ID NO: 14998 - DNA, 13 bp, Artificial Sequence
  synthetic sequence
ggcaatgccagac

SEQ ID NO: 14999 - DNA, 13 bp, Artificial Sequence
  synthetic sequence
aaaccaggctttt

SEQ ID NO: 15000 - DNA, 13 bp, Artificial Sequence
  synthetic sequence
cgaaagtacgcgt

SEQ ID NO: 15001 - DNA, 13 bp, Artificial Sequence
  synthetic sequence
caatcttttcgca

SEQ ID NO: 15002 - DNA, 13 bp, Artificial Sequence
  synthetic sequence
attttgcccagga

SEQ ID NO: 15003 - DNA, 13 bp, Artificial Sequence
  synthetic sequence
cgaacaaaccgat

SEQ ID NO: 15004 - DNA, 13 bp, Artificial Sequence
  synthetic sequence
cggcagcaagaag

SEQ ID NO: 15005 - DNA, 13 bp, Artificial Sequence
  synthetic sequence
gtattgcactagg

SEQ ID NO: 15006 - DNA, 13 bp, Artificial Sequence
  synthetic sequence
tagcgatacaaat

SEQ ID NO: 15007 - DNA, 13 bp, Artificial Sequence
  synthetic sequence
cctggattaccgt

SEQ ID NO: 15008 - DNA, 13 bp, Artificial Sequence
  synthetic sequence
gagatcgatccag

SEQ ID NO: 15009 - DNA, 13 bp, Artificial Sequence
  synthetic sequence
aaacgatgcccat

SEQ ID NO: 15010 - DNA, 13 bp, Artificial Sequence
  synthetic sequence
attacgatatgcg

SEQ ID NO: 15011 - DNA, 13 bp, Artificial Sequence
  synthetic sequence
ttcaagaatgcgc

SEQ ID NO: 15012 - DNA, 13 bp, Artificial Sequence
  synthetic sequence
cgatgacggcctc

SEQ ID NO: 15013 - DNA, 13 bp, Artificial Sequence
  synthetic sequence
gattgccgacggc

SEQ ID NO: 15014 - DNA, 13 bp, Artificial Sequence
  synthetic sequence
accaaagacaaaa

SEQ ID NO: 15015 - DNA, 13 bp, Artificial Sequence
  synthetic sequence
cctaccaatgggc

SEQ ID NO: 15016 - DNA, 13 bp, Artificial Sequence
  synthetic sequence
ttttctcattatc

SEQ ID NO: 15017 - DNA, 13 bp, Artificial Sequence
  synthetic sequence
aaaaggaaatcat

SEQ ID NO: 15018 - DNA, 13 bp, Artificial Sequence
  synthetic sequence
gtggcaaagcctg

SEQ ID NO: 15019 - DNA, 13 bp, Artificial Sequence
  synthetic sequence
cagtattgcttgc

SEQ ID NO: 15020 - DNA, 13 bp, Artificial Sequence
  synthetic sequence
ccggggaactgag

SEQ ID NO: 15021 - DNA, 13 bp, Artificial Sequence
  synthetic sequence
tcaactatttggt

SEQ ID NO: 15022 - DNA, 13 bp, Artificial Sequence
  synthetic sequence
ctccctgccatta

SEQ ID NO: 15023 - DNA, 13 bp, Artificial Sequence
  synthetic sequence
atcacaaggggaa

SEQ ID NO: 15024 - DNA, 13 bp, Artificial Sequence
  synthetic sequence
tgactaacacacc

SEQ ID NO: 15025 - DNA, 13 bp, Artificial Sequence
  synthetic sequence
atcgggacacatg

SEQ ID NO: 15026 - DNA, 13 bp, Artificial Sequence
  synthetic sequence
ggcgtgaaaaggt

SEQ ID NO: 15027 - DNA, 13 bp, Artificial Sequence
  synthetic sequence
aagccttacgccg

SEQ ID NO: 15028 - DNA, 13 bp, Artificial Sequence
  synthetic sequence
aaggaagtcaaaa

SEQ ID NO: 15029 - DNA, 13 bp, Artificial Sequence
  synthetic sequence
cattgatctattt

SEQ ID NO: 15030 - DNA, 13 bp, Artificial Sequence
  synthetic sequence
acgatgtatgtca

SEQ ID NO: 15031 - DNA, 13 bp, Artificial Sequence
  synthetic sequence
cccgcgaagaatg

SEQ ID NO: 15032 - DNA, 13 bp, Artificial Sequence
  synthetic sequence
tggcatcgtccac

SEQ ID NO: 15033 - DNA, 13 bp, Artificial Sequence
  synthetic sequence
tttgttgttcgac

SEQ ID NO: 15034 - DNA, 13 bp, Artificial Sequence
  synthetic sequence
atctcgccgcatc

SEQ ID NO: 15035 - DNA, 13 bp, Artificial Sequence
  synthetic sequence
tcaaaggtacgga

SEQ ID NO: 15036 - DNA, 13 bp, Artificial Sequence
  synthetic sequence
cttctctctgccg

SEQ ID NO: 15037 - DNA, 13 bp, Artificial Sequence
  synthetic sequence
ttgcgctgtcgct

SEQ ID NO: 15038 - DNA, 13 bp, Artificial Sequence
  synthetic sequence
catgctcaccagc

SEQ ID NO: 15039 - DNA, 13 bp, Artificial Sequence
  synthetic sequence
agatcgccatgta

SEQ ID NO: 15040 - DNA, 13 bp, Artificial Sequence
  synthetic sequence
ctttggcgaattc

SEQ ID NO: 15041 - DNA, 13 bp, Artificial Sequence
  synthetic sequence
tggatgcgtcctg

SEQ ID NO: 15042 - DNA, 13 bp, Artificial Sequence
  synthetic sequence
tactcgtatcacg

SEQ ID NO: 15043 - DNA, 13 bp, Artificial Sequence
  synthetic sequence
tgttcaaaacgac

SEQ ID NO: 15044 - DNA, 13 bp, Artificial Sequence
  synthetic sequence
tcactaatatacg

SEQ ID NO: 15045 - DNA, 13 bp, Artificial Sequence
  synthetic sequence
acaaacagagact

SEQ ID NO: 15046 - DNA, 13 bp, Artificial Sequence
  synthetic sequence
ccgggaggggata

SEQ ID NO: 15047 - DNA, 13 bp, Artificial Sequence
  synthetic sequence
gctggaactttat

SEQ ID NO: 15048 - DNA, 13 bp, Artificial Sequence
  synthetic sequence
agtgcagttgcct

SEQ ID NO: 15049 - DNA, 13 bp, Artificial Sequence
  synthetic sequence
aacaccgagaaat

SEQ ID NO: 15050 - DNA, 13 bp, Artificial Sequence
  synthetic sequence
gttttgcagcgca

SEQ ID NO: 15051 - DNA, 13 bp, Artificial Sequence
  synthetic sequence
gtagcagcctcaa

SEQ ID NO: 15052 - DNA, 13 bp, Artificial Sequence
  synthetic sequence
acaactcattgat

SEQ ID NO: 15053 - DNA, 13 bp, Artificial Sequence
  synthetic sequence
cctgttttaattt

SEQ ID NO: 15054 - DNA, 13 bp, Artificial Sequence
  synthetic sequence
tgttatttgctga

SEQ ID NO: 15055 - DNA, 13 bp, Artificial Sequence
  synthetic sequence
cctatacgatcat

SEQ ID NO: 15056 - DNA, 13 bp, Artificial Sequence
  synthetic sequence
ataacacctgcga

SEQ ID NO: 15057 - DNA, 13 bp, Artificial Sequence
  synthetic sequence
gaacacgtactga

SEQ ID NO: 15058 - DNA, 13 bp, Artificial Sequence
  synthetic sequence
cagcaccacgagg

SEQ ID NO: 15059 - DNA, 13 bp, Artificial Sequence
  synthetic sequence
tcagcgtttctat

SEQ ID NO: 15060 - DNA, 13 bp, Artificial Sequence
  synthetic sequence
tcttccgattaaa

SEQ ID NO: 15061 - DNA, 13 bp, Artificial Sequence
  synthetic sequence
gatgctctatcta

SEQ ID NO: 15062 - DNA, 13 bp, Artificial Sequence
  synthetic sequence
aagttcagatgga

SEQ ID NO: 15063 - DNA, 13 bp, Artificial Sequence
  synthetic sequence
ccttcattatgcc

SEQ ID NO: 15064 - DNA, 13 bp, Artificial Sequence
  synthetic sequence
tgatgctggcccg

SEQ ID NO: 15065 - DNA, 13 bp, Artificial Sequence
  synthetic sequence
taaagcccttcaa

SEQ ID NO: 15066 - DNA, 13 bp, Artificial Sequence
  synthetic sequence
tcctggccaaggc

SEQ ID NO: 15067 - DNA, 13 bp, Artificial Sequence
  synthetic sequence
atactcgaaaagg

SEQ ID NO: 15068 - DNA, 13 bp, Artificial Sequence
  synthetic sequence
ttccgatattaaa

SEQ ID NO: 15069 - DNA, 13 bp, Artificial Sequence
  synthetic sequence
gatcatcaagcag

SEQ ID NO: 15070 - DNA, 13 bp, Artificial Sequence
  synthetic sequence
gcataccagccaa

SEQ ID NO: 15071 - DNA, 13 bp, Artificial Sequence
  synthetic sequence
gttttgagtatag

SEQ ID NO: 15072 - DNA, 13 bp, Artificial Sequence
  synthetic sequence
gcaatgttgacaa

SEQ ID NO: 15073 - DNA, 13 bp, Artificial Sequence
  synthetic sequence
gatttcaagacaa

SEQ ID NO: 15074 - DNA, 13 bp, Artificial Sequence
  synthetic sequence
cagttgctggccg

SEQ ID NO: 15075 - DNA, 13 bp, Artificial Sequence
  synthetic sequence
tctctccgatttg

SEQ ID NO: 15076 - DNA, 13 bp, Artificial Sequence
  synthetic sequence
aactaccgcttcg

SEQ ID NO: 15077 - DNA, 13 bp, Artificial Sequence
  synthetic sequence
atttaccctggca

SEQ ID NO: 15078 - DNA, 13 bp, Artificial Sequence
  synthetic sequence
gtctgtacggctg

SEQ ID NO: 15079 - DNA, 13 bp, Artificial Sequence
  synthetic sequence
tagaatggtcctc

SEQ ID NO: 15080 - DNA, 13 bp, Artificial Sequence
  synthetic sequence
cgccgatctcaat

SEQ ID NO: 15081 - DNA, 13 bp, Artificial Sequence
  synthetic sequence
acgtgcttcgtat

SEQ ID NO: 15082 - DNA, 13 bp, Artificial Sequence
  synthetic sequence
cggaagagaaact

SEQ ID NO: 15083 - DNA, 13 bp, Artificial Sequence
  synthetic sequence
gctatcctgccgg

SEQ ID NO: 15084 - DNA, 13 bp, Artificial Sequence
  synthetic sequence
attttggcagctt

SEQ ID NO: 15085 - DNA, 13 bp, Artificial Sequence
  synthetic sequence
atgcgtatttatt

SEQ ID NO: 15086 - DNA, 13 bp, Artificial Sequence
  synthetic sequence
tgaaggagttggc

SEQ ID NO: 15087 - DNA, 13 bp, Artificial Sequence
  synthetic sequence
gctggccctttgg

SEQ ID NO: 15088 - DNA, 13 bp, Artificial Sequence
  synthetic sequence
gcaggaagaaatc

SEQ ID NO: 15089 - DNA, 13 bp, Artificial Sequence
  synthetic sequence
attttcgcgtggg

SEQ ID NO: 15090 - DNA, 13 bp, Artificial Sequence
  synthetic sequence
gcggcatgatccg

SEQ ID NO: 15091 - DNA, 13 bp, Artificial Sequence
  synthetic sequence
gggctaaagtgct

SEQ ID NO: 15092 - DNA, 13 bp, Artificial Sequence
  synthetic sequence
tgctgcggtttct

SEQ ID NO: 15093 - DNA, 13 bp, Artificial Sequence
  synthetic sequence
gaggccaatacat

SEQ ID NO: 15094 - DNA, 13 bp, Artificial Sequence
  synthetic sequence
ttcgccgtgagca

SEQ ID NO: 15095 - DNA, 13 bp, Artificial Sequence
  synthetic sequence
tcctcaaccaata

SEQ ID NO: 15096 - DNA, 13 bp, Artificial Sequence
  synthetic sequence
aacgccgtggcag

SEQ ID NO: 15097 - DNA, 13 bp, Artificial Sequence
  synthetic sequence
tagaacctaataa

SEQ ID NO: 15098 - DNA, 13 bp, Artificial Sequence
  synthetic sequence
gagttttatgatt

SEQ ID NO: 15099 - DNA, 13 bp, Artificial Sequence
  synthetic sequence
acccgatcgccca

SEQ ID NO: 15100 - DNA, 13 bp, Artificial Sequence
  synthetic sequence
ggtgtgggaagaa

SEQ ID NO: 15101 - DNA, 13 bp, Artificial Sequence
  synthetic sequence
acatcaccttcct

SEQ ID NO: 15102 - DNA, 13 bp, Artificial Sequence
  synthetic sequence
catgaatgatcca

SEQ ID NO: 15103 - DNA, 13 bp, Artificial Sequence
  synthetic sequence
aggaagctgctac

SEQ ID NO: 15104 - DNA, 13 bp, Artificial Sequence
  synthetic sequence
gtaccaatgcgcc

SEQ ID NO: 15105 - DNA, 13 bp, Artificial Sequence
  synthetic sequence
ttaaatctagtgc

SEQ ID NO: 15106 - DNA, 13 bp, Artificial Sequence
  synthetic sequence
tgcagcgcgaatt

SEQ ID NO: 15107 - DNA, 13 bp, Artificial Sequence
  synthetic sequence
gccaactccagta

SEQ ID NO: 15108 - DNA, 13 bp, Artificial Sequence
  synthetic sequence
gcgattctggcgc

SEQ ID NO: 15109 - DNA, 13 bp, Artificial Sequence
  synthetic sequence
tgcgctcatcgtc

SEQ ID NO: 15110 - DNA, 13 bp, Artificial Sequence
  synthetic sequence
ccgatgttgtgat

SEQ ID NO: 15111 - DNA, 13 bp, Artificial Sequence
  synthetic sequence
gacgatcacgaaa

SEQ ID NO: 15112 - DNA, 13 bp, Artificial Sequence
  synthetic sequence
ggccgaagtcctt

SEQ ID NO: 15113 - DNA, 13 bp, Artificial Sequence
  synthetic sequence
aagatcagcgctg

SEQ ID NO: 15114 - DNA, 13 bp, Artificial Sequence
  synthetic sequence
ttcctggaacgcc

SEQ ID NO: 15115 - DNA, 13 bp, Artificial Sequence
  synthetic sequence
ggatgagattaat

SEQ ID NO: 15116 - DNA, 13 bp, Artificial Sequence
  synthetic sequence
attgtcaaaagaa

SEQ ID NO: 15117 - DNA, 13 bp, Artificial Sequence
  synthetic sequence
aggtgaagtggta

SEQ ID NO: 15118 - DNA, 13 bp, Artificial Sequence
  synthetic sequence
acaatcccattgc

SEQ ID NO: 15119 - DNA, 13 bp, Artificial Sequence
  synthetic sequence
accgatgatgtgt

SEQ ID NO: 15120 - DNA, 13 bp, Artificial Sequence
  synthetic sequence
tatcgtcgccgca

SEQ ID NO: 15121 - DNA, 13 bp, Artificial Sequence
  synthetic sequence
gcaaacgcaggat

SEQ ID NO: 15122 - DNA, 13 bp, Artificial Sequence
  synthetic sequence
actcagaagcaga

SEQ ID NO: 15123 - DNA, 13 bp, Artificial Sequence
  synthetic sequence
cggcacattatta

SEQ ID NO: 15124 - DNA, 13 bp, Artificial Sequence
  synthetic sequence
gaaaggtggcttc

SEQ ID NO: 15125 - DNA, 13 bp, Artificial Sequence
  synthetic sequence
ggttccgtggtca

SEQ ID NO: 15126 - DNA, 13 bp, Artificial Sequence
  synthetic sequence
ttaatcgcctgga

SEQ ID NO: 15127 - DNA, 13 bp, Artificial Sequence
  synthetic sequence
gcattctggccca

SEQ ID NO: 15128 - DNA, 13 bp, Artificial Sequence
  synthetic sequence
ggtaaatcaccaa

SEQ ID NO: 15129 - DNA, 13 bp, Artificial Sequence
  synthetic sequence
attttgctaatct

SEQ ID NO: 15130 - DNA, 13 bp, Artificial Sequence
  synthetic sequence
gtcgtgcaatacg

SEQ ID NO: 15131 - DNA, 13 bp, Artificial Sequence
  synthetic sequence
ggaatcagtacgc

SEQ ID NO: 15132 - DNA, 13 bp, Artificial Sequence
  synthetic sequence
caggcgcccaata

SEQ ID NO: 15133 - DNA, 13 bp, Artificial Sequence
  synthetic sequence
gttttaattcttc

SEQ ID NO: 15134 - DNA, 13 bp, Artificial Sequence
  synthetic sequence
aatatgcagtagt

SEQ ID NO: 15135 - DNA, 13 bp, Artificial Sequence
  synthetic sequence
catgcccgaagtg

SEQ ID NO: 15136 - DNA, 13 bp, Artificial Sequence
  synthetic sequence
agcaactgcagcg

SEQ ID NO: 15137 - DNA, 13 bp, Artificial Sequence
  synthetic sequence
atccagcctggtt

SEQ ID NO: 15138 - DNA, 13 bp, Artificial Sequence
  synthetic sequence
tttgcgggcgtac

SEQ ID NO: 15139 - DNA, 13 bp, Artificial Sequence
  synthetic sequence
aaatttgatgctc

SEQ ID NO: 15140 - DNA, 13 bp, Artificial Sequence
  synthetic sequence
cagaagcgcgtaa

SEQ ID NO: 15141 - DNA, 13 bp, Artificial Sequence
  synthetic sequence
ctcggggtgatcg

SEQ ID NO: 15142 - DNA, 13 bp, Artificial Sequence
  synthetic sequence
gtgatcaccccgg

SEQ ID NO: 15143 - DNA, 13 bp, Artificial Sequence
  synthetic sequence
gacgatgtgctca

SEQ ID NO: 15144 - DNA, 13 bp, Artificial Sequence
  synthetic sequence
ccccagaaagact

SEQ ID NO: 15145 - DNA, 13 bp, Artificial Sequence
  synthetic sequence
taattagcccgat

SEQ ID NO: 15146 - DNA, 13 bp, Artificial Sequence
  synthetic sequence
ctgaaacgtaaag

SEQ ID NO: 15147 - DNA, 13 bp, Artificial Sequence
  synthetic sequence
actggcagggatc

SEQ ID NO: 15148 - DNA, 13 bp, Artificial Sequence
  synthetic sequence
acaagtaatcgag

SEQ ID NO: 15149 - DNA, 13 bp, Artificial Sequence
  synthetic sequence
gccttgtcacggt

SEQ ID NO: 15150 - DNA, 13 bp, Artificial Sequence
  synthetic sequence
tagaatagattgt

SEQ ID NO: 15151 - DNA, 13 bp, Artificial Sequence
  synthetic sequence
gacagtgcagcag

SEQ ID NO: 15152 - DNA, 13 bp, Artificial Sequence
  synthetic sequence
tcaagcaccttaa

SEQ ID NO: 15153 - DNA, 13 bp, Artificial Sequence
  synthetic sequence
tgatcaaccgggt

SEQ ID NO: 15154 - DNA, 13 bp, Artificial Sequence
  synthetic sequence
agcagatttgctc

SEQ ID NO: 15155 - DNA, 13 bp, Artificial Sequence
  synthetic sequence
aaaatgcgatcga

SEQ ID NO: 15156 - DNA, 13 bp, Artificial Sequence
  synthetic sequence
cgcgatctgctga

SEQ ID NO: 15157 - DNA, 13 bp, Artificial Sequence
  synthetic sequence
ctgcggattgttc

SEQ ID NO: 15158 - DNA, 13 bp, Artificial Sequence
  synthetic sequence
cttcgccttatga

SEQ ID NO: 15159 - DNA, 13 bp, Artificial Sequence
  synthetic sequence
cggggagaaaggt

SEQ ID NO: 15160 - DNA, 13 bp, Artificial Sequence
  synthetic sequence
ggactggtgcgtc

SEQ ID NO: 15161 - DNA, 13 bp, Artificial Sequence
  synthetic sequence
gccttctgaatgt

SEQ ID NO: 15162 - DNA, 13 bp, Artificial Sequence
  synthetic sequence
attacgtggatac

SEQ ID NO: 15163 - DNA, 13 bp, Artificial Sequence
  synthetic sequence
gttgctccattaa

SEQ ID NO: 15164 - DNA, 13 bp, Artificial Sequence
  synthetic sequence
cgctgcaaaatga

SEQ ID NO: 15165 - DNA, 13 bp, Artificial Sequence
  synthetic sequence
ctggtatgttcag

SEQ ID NO: 15166 - DNA, 13 bp, Artificial Sequence
  synthetic sequence
gagcaacgtacga

SEQ ID NO: 15167 - DNA, 13 bp, Artificial Sequence
  synthetic sequence
ctgcacaaaactt

SEQ ID NO: 15168 - DNA, 13 bp, Artificial Sequence
  synthetic sequence
gcatacacacgcg

SEQ ID NO: 15169 - DNA, 13 bp, Artificial Sequence
  synthetic sequence
cgttggccgcatc

SEQ ID NO: 15170 - DNA, 13 bp, Artificial Sequence
  synthetic sequence
ttacgccgatccc

SEQ ID NO: 15171 - DNA, 13 bp, Artificial Sequence
  synthetic sequence
atatagtgataac

SEQ ID NO: 15172 - DNA, 13 bp, Artificial Sequence
  synthetic sequence
atcctgtatctaa

SEQ ID NO: 15173 - DNA, 13 bp, Artificial Sequence
  synthetic sequence
cagatttggtaac

SEQ ID NO: 15174 - DNA, 13 bp, Artificial Sequence
  synthetic sequence
ccattactagtcg

SEQ ID NO: 15175 - DNA, 13 bp, Artificial Sequence
  synthetic sequence
cacgcgcagcgtt

SEQ ID NO: 15176 - DNA, 13 bp, Artificial Sequence
  synthetic sequence
gttgcatcgacac

SEQ ID NO: 15177 - DNA, 13 bp, Artificial Sequence
  synthetic sequence
tcagggtgatcac

SEQ ID NO: 15178 - DNA, 13 bp, Artificial Sequence
  synthetic sequence
ttcaaggcggcgc

SEQ ID NO: 15179 - DNA, 13 bp, Artificial Sequence
  synthetic sequence
cggcgatcaacac

SEQ ID NO: 15180 - DNA, 13 bp, Artificial Sequence
  synthetic sequence
agcagcagcgtcc

SEQ ID NO: 15181 - DNA, 13 bp, Artificial Sequence
  synthetic sequence
ccgatggtggtca

SEQ ID NO: 15182 - DNA, 13 bp, Artificial Sequence
  synthetic sequence
taatgacattgat

SEQ ID NO: 15183 - DNA, 13 bp, Artificial Sequence
  synthetic sequence
aaacgttgatcct

SEQ ID NO: 15184 - DNA, 13 bp, Artificial Sequence
  synthetic sequence
gtaatatgccaga

SEQ ID NO: 15185 - DNA, 13 bp, Artificial Sequence
  synthetic sequence
tccaatgagctca

SEQ ID NO: 15186 - DNA, 13 bp, Artificial Sequence
  synthetic sequence
cgatggccacgtc

SEQ ID NO: 15187 - DNA, 13 bp, Artificial Sequence
  synthetic sequence
acggaaccatctc

SEQ ID NO: 15188 - DNA, 13 bp, Artificial Sequence
  synthetic sequence
ttaatgtttgaag

SEQ ID NO: 15189 - DNA, 13 bp, Artificial Sequence
  synthetic sequence
gattggccctatt

SEQ ID NO: 15190 - DNA, 13 bp, Artificial Sequence
  synthetic sequence
gtatcggttacct

SEQ ID NO: 15191 - DNA, 13 bp, Artificial Sequence
  synthetic sequence
tgtaaatagcaat

SEQ ID NO: 15192 - DNA, 13 bp, Artificial Sequence
  synthetic sequence
gaccagggcgatc

SEQ ID NO: 15193 - DNA, 13 bp, Artificial Sequence
  synthetic sequence
tgaggctcgcacg

SEQ ID NO: 15194 - DNA, 13 bp, Artificial Sequence
  synthetic sequence
tagtggatcttcc

SEQ ID NO: 15195 - DNA, 13 bp, Artificial Sequence
  synthetic sequence
ctagggctttgga

SEQ ID NO: 15196 - DNA, 13 bp, Artificial Sequence
  synthetic sequence
aagaaatccatgg

SEQ ID NO: 15197 - DNA, 13 bp, Artificial Sequence
  synthetic sequence
aattgtatgctgg

SEQ ID NO: 15198 - DNA, 13 bp, Artificial Sequence
  synthetic sequence
acgcgcagtcgat

SEQ ID NO: 15199 - DNA, 13 bp, Artificial Sequence
  synthetic sequence
tcgccctggctga

SEQ ID NO: 15200 - DNA, 13 bp, Artificial Sequence
  synthetic sequence
atacatcgccggt

SEQ ID NO: 15201 - DNA, 13 bp, Artificial Sequence
  synthetic sequence
ggaaatcacgctc

SEQ ID NO: 15202 - DNA, 13 bp, Artificial Sequence
  synthetic sequence
tcactcaagtaat

SEQ ID NO: 15203 - DNA, 13 bp, Artificial Sequence
  synthetic sequence
accccatgccaat

SEQ ID NO: 15204 - DNA, 13 bp, Artificial Sequence
  synthetic sequence
aattcggcggtgg

SEQ ID NO: 15205 - DNA, 13 bp, Artificial Sequence
  synthetic sequence
gcgacggctttct

SEQ ID NO: 15206 - DNA, 13 bp, Artificial Sequence
  synthetic sequence
cattctgaatctc

SEQ ID NO: 15207 - DNA, 13 bp, Artificial Sequence
  synthetic sequence
tggtattcatcgg

SEQ ID NO: 15208 - DNA, 13 bp, Artificial Sequence
  synthetic sequence
agcattccaggta

SEQ ID NO: 15209 - DNA, 13 bp, Artificial Sequence
  synthetic sequence
ctcagctgcgtca

SEQ ID NO: 15210 - DNA, 13 bp, Artificial Sequence
  synthetic sequence
tgctcgtggtacc

SEQ ID NO: 15211 - DNA, 13 bp, Artificial Sequence
  synthetic sequence
cgaccactgccaa

SEQ ID NO: 15212 - DNA, 13 bp, Artificial Sequence
  synthetic sequence
gtttgagaatgaa

SEQ ID NO: 15213 - DNA, 13 bp, Artificial Sequence
  synthetic sequence
cttcaggccctcg

SEQ ID NO: 15214 - DNA, 13 bp, Artificial Sequence
  synthetic sequence
aggtactaccgaa

SEQ ID NO: 15215 - DNA, 13 bp, Artificial Sequence
  synthetic sequence
tggctggcacgct

SEQ ID NO: 15216 - DNA, 13 bp, Artificial Sequence
  synthetic sequence
gattcccctgcct

SEQ ID NO: 15217 - DNA, 13 bp, Artificial Sequence
  synthetic sequence
gcctggtcaccga

SEQ ID NO: 15218 - DNA, 13 bp, Artificial Sequence
  synthetic sequence
gcgaactgcaatt

SEQ ID NO: 15219 - DNA, 13 bp, Artificial Sequence
  synthetic sequence
gtcgacgttcaaa

SEQ ID NO: 15220 - DNA, 13 bp, Artificial Sequence
  synthetic sequence
acgtggtggcatt

SEQ ID NO: 15221 - DNA, 13 bp, Artificial Sequence
  synthetic sequence
ggcgaagtcttga

SEQ ID NO: 15222 - DNA, 13 bp, Artificial Sequence
  synthetic sequence
caagagccgaact

SEQ ID NO: 15223 - DNA, 13 bp, Artificial Sequence
  synthetic sequence
tattccattttga

SEQ ID NO: 15224 - DNA, 13 bp, Artificial Sequence
  synthetic sequence
agcagtgggttcg

SEQ ID NO: 15225 - DNA, 13 bp, Artificial Sequence
  synthetic sequence
cggtacttattgc

SEQ ID NO: 15226 - DNA, 13 bp, Artificial Sequence
  synthetic sequence
aataactttcctt

SEQ ID NO: 15227 - DNA, 13 bp, Artificial Sequence
  synthetic sequence
gcgtactgttcca

SEQ ID NO: 15228 - DNA, 13 bp, Artificial Sequence
  synthetic sequence
aagagggaccggt

SEQ ID NO: 15229 - DNA, 13 bp, Artificial Sequence
  synthetic sequence
tgacctcggcctc

SEQ ID NO: 15230 - DNA, 13 bp, Artificial Sequence
  synthetic sequence
ttaagagatgctt

SEQ ID NO: 15231 - DNA, 13 bp, Artificial Sequence
  synthetic sequence
ctgctgaccatgc

SEQ ID NO: 15232 - DNA, 13 bp, Artificial Sequence
  synthetic sequence
tacagaaccgcgt

SEQ ID NO: 15233 - DNA, 13 bp, Artificial Sequence
  synthetic sequence
ggggcaatacaag

SEQ ID NO: 15234 - DNA, 13 bp, Artificial Sequence
  synthetic sequence
cccgatggagctc

SEQ ID NO: 15235 - DNA, 13 bp, Artificial Sequence
  synthetic sequence
gttcaggctggcg

SEQ ID NO: 15236 - DNA, 13 bp, Artificial Sequence
  synthetic sequence
aaacagatccccg

SEQ ID NO: 15237 - DNA, 13 bp, Artificial Sequence
  synthetic sequence
actttaaataccg

SEQ ID NO: 15238 - DNA, 13 bp, Artificial Sequence
  synthetic sequence
tgaacattatcaa

SEQ ID NO: 15239 - DNA, 13 bp, Artificial Sequence
  synthetic sequence
tactgcgcagaat

SEQ ID NO: 15240 - DNA, 13 bp, Artificial Sequence
  synthetic sequence
ataagctctagcc

SEQ ID NO: 15241 - DNA, 13 bp, Artificial Sequence
  synthetic sequence
taaagctggctta

SEQ ID NO: 15242 - DNA, 13 bp, Artificial Sequence
  synthetic sequence
aaacgctatacaa

SEQ ID NO: 15243 - DNA, 13 bp, Artificial Sequence
  synthetic sequence
atgtccgggttgg

SEQ ID NO: 15244 - DNA, 13 bp, Artificial Sequence
  synthetic sequence
ctcgaaaactaaa

SEQ ID NO: 15245 - DNA, 13 bp, Artificial Sequence
  synthetic sequence
ggatgcaacctcc

SEQ ID NO: 15246 - DNA, 13 bp, Artificial Sequence
  synthetic sequence
agaaaacgcttca

SEQ ID NO: 15247 - DNA, 13 bp, Artificial Sequence
  synthetic sequence
aagctgtgagctg

SEQ ID NO: 15248 - DNA, 13 bp, Artificial Sequence
  synthetic sequence
cgtcgagagcttc

SEQ ID NO: 15249 - DNA, 13 bp, Artificial Sequence
  synthetic sequence
tggcctcgtatgt

SEQ ID NO: 15250 - DNA, 13 bp, Artificial Sequence
  synthetic sequence
gagtatgacgaga

SEQ ID NO: 15251 - DNA, 13 bp, Artificial Sequence
  synthetic sequence
tagctctcgttcg

SEQ ID NO: 15252 - DNA, 13 bp, Artificial Sequence
  synthetic sequence
cgcattactggcc

SEQ ID NO: 15253 - DNA, 13 bp, Artificial Sequence
  synthetic sequence
ccaatgcaccctg

SEQ ID NO: 15254 - DNA, 13 bp, Artificial Sequence
  synthetic sequence
tctattatgtgta

SEQ ID NO: 15255 - DNA, 13 bp, Artificial Sequence
  synthetic sequence
cacctccatggtt

SEQ ID NO: 15256 - DNA, 13 bp, Artificial Sequence
  synthetic sequence
accaatcggcagg

SEQ ID NO: 15257 - DNA, 13 bp, Artificial Sequence
  synthetic sequence
cgcaaggctggag

SEQ ID NO: 15258 - DNA, 13 bp, Artificial Sequence
  synthetic sequence
agcaacaaattcg

SEQ ID NO: 15259 - DNA, 13 bp, Artificial Sequence
  synthetic sequence
actgaactcatca

SEQ ID NO: 15260 - DNA, 13 bp, Artificial Sequence
  synthetic sequence
tggttgaaaatct

SEQ ID NO: 15261 - DNA, 13 bp, Artificial Sequence
  synthetic sequence
ccgctacaacttt

SEQ ID NO: 15262 - DNA, 13 bp, Artificial Sequence
  synthetic sequence
gttagggatgctt

SEQ ID NO: 15263 - DNA, 13 bp, Artificial Sequence
  synthetic sequence
agttctatatggt

SEQ ID NO: 15264 - DNA, 13 bp, Artificial Sequence
  synthetic sequence
aggcagtaaggcc

SEQ ID NO: 15265 - DNA, 13 bp, Artificial Sequence
  synthetic sequence
tccacatggccat

SEQ ID NO: 15266 - DNA, 13 bp, Artificial Sequence
  synthetic sequence
tctactgtcaatc

SEQ ID NO: 15267 - DNA, 13 bp, Artificial Sequence
  synthetic sequence
agcgcgccgaaca

SEQ ID NO: 15268 - DNA, 13 bp, Artificial Sequence
  synthetic sequence
gctggcggaaaag

SEQ ID NO: 15269 - DNA, 13 bp, Artificial Sequence
  synthetic sequence
gggaagtggtcgc

SEQ ID NO: 15270 - DNA, 13 bp, Artificial Sequence
  synthetic sequence
caagcagacccag

SEQ ID NO: 15271 - DNA, 13 bp, Artificial Sequence
  synthetic sequence
tcggtatctgtat

SEQ ID NO: 15272 - DNA, 13 bp, Artificial Sequence
  synthetic sequence
ctgatcagcagac

SEQ ID NO: 15273 - DNA, 13 bp, Artificial Sequence
  synthetic sequence
caaggtgtgtctc

SEQ ID NO: 15274 - DNA, 13 bp, Artificial Sequence
  synthetic sequence
aagggaaatggga

SEQ ID NO: 15275 - DNA, 13 bp, Artificial Sequence
  synthetic sequence
acagtttccttga

SEQ ID NO: 15276 - DNA, 13 bp, Artificial Sequence
  synthetic sequence
gcctgttccgtgg

SEQ ID NO: 15277 - DNA, 13 bp, Artificial Sequence
  synthetic sequence
ataccggctatgc

SEQ ID NO: 15278 - DNA, 13 bp, Artificial Sequence
  synthetic sequence
gcgaaggcatgac

SEQ ID NO: 15279 - DNA, 13 bp, Artificial Sequence
  synthetic sequence
tggctgccaagtc

SEQ ID NO: 15280 - DNA, 13 bp, Artificial Sequence
  synthetic sequence
ttaactcatgaga

SEQ ID NO: 15281 - DNA, 13 bp, Artificial Sequence
  synthetic sequence
cgtatctcgtgga

SEQ ID NO: 15282 - DNA, 13 bp, Artificial Sequence
  synthetic sequence
gaaacaccatcca

SEQ ID NO: 15283 - DNA, 13 bp, Artificial Sequence
  synthetic sequence
gaaaggaatgatg

SEQ ID NO: 15284 - DNA, 13 bp, Artificial Sequence
  synthetic sequence
cgaggtctcgtag

SEQ ID NO: 15285 - DNA, 13 bp, Artificial Sequence
  synthetic sequence
aaggtccactgtc

SEQ ID NO: 15286 - DNA, 13 bp, Artificial Sequence
  synthetic sequence
tcctcataacaaa

SEQ ID NO: 15287 - DNA, 13 bp, Artificial Sequence
  synthetic sequence
tcatcggcaggct

SEQ ID NO: 15288 - DNA, 13 bp, Artificial Sequence
  synthetic sequence
ttaagagaaatga

SEQ ID NO: 15289 - DNA, 13 bp, Artificial Sequence
  synthetic sequence
atctttcagcgcg

SEQ ID NO: 15290 - DNA, 13 bp, Artificial Sequence
  synthetic sequence
ctcgcagtaaatt

SEQ ID NO: 15291 - DNA, 13 bp, Artificial Sequence
  synthetic sequence
acaggtcagcggc

SEQ ID NO: 15292 - DNA, 13 bp, Artificial Sequence
  synthetic sequence
acgttgaagtacc

SEQ ID NO: 15293 - DNA, 13 bp, Artificial Sequence
  synthetic sequence
ccagccctctgag

SEQ ID NO: 15294 - DNA, 13 bp, Artificial Sequence
  synthetic sequence
ttggtgctgcaat

SEQ ID NO: 15295 - DNA, 13 bp, Artificial Sequence
  synthetic sequence
gacgtcatcaatg

SEQ ID NO: 15296 - DNA, 13 bp, Artificial Sequence
  synthetic sequence
gcaacgttctgat

SEQ ID NO: 15297 - DNA, 13 bp, Artificial Sequence
  synthetic sequence
atcttggtgctgg

SEQ ID NO: 15298 - DNA, 13 bp, Artificial Sequence
  synthetic sequence
gaaacagcaaaat

SEQ ID NO: 15299 - DNA, 13 bp, Artificial Sequence
  synthetic sequence
agttcgtgatcga

SEQ ID NO: 15300 - DNA, 13 bp, Artificial Sequence
  synthetic sequence
agtgaatttatgg

SEQ ID NO: 15301 - DNA, 13 bp, Artificial Sequence
  synthetic sequence
aacaggggattga

SEQ ID NO: 15302 - DNA, 13 bp, Artificial Sequence
  synthetic sequence
tttctacaccttg

SEQ ID NO: 15303 - DNA, 13 bp, Artificial Sequence
  synthetic sequence
atgtttcaaattc

SEQ ID NO: 15304 - DNA, 13 bp, Artificial Sequence
  synthetic sequence
ctaaaactgatgt

SEQ ID NO: 15305 - DNA, 13 bp, Artificial Sequence
  synthetic sequence
tctcaaccgttgc

SEQ ID NO: 15306 - DNA, 13 bp, Artificial Sequence
  synthetic sequence
atgctgccgcgta

SEQ ID NO: 15307 - DNA, 13 bp, Artificial Sequence
  synthetic sequence
catcgaggccgac

SEQ ID NO: 15308 - DNA, 13 bp, Artificial Sequence
  synthetic sequence
tagcccaggcgca

SEQ ID NO: 15309 - DNA, 13 bp, Artificial Sequence
  synthetic sequence
gacagatagttgg

SEQ ID NO: 15310 - DNA, 13 bp, Artificial Sequence
  synthetic sequence
aagctttcattat

SEQ ID NO: 15311 - DNA, 13 bp, Artificial Sequence
  synthetic sequence
ctggctgatgtgg

SEQ ID NO: 15312 - DNA, 13 bp, Artificial Sequence
  synthetic sequence
caccccagcactt

SEQ ID NO: 15313 - DNA, 13 bp, Artificial Sequence
  synthetic sequence
aggaacgcgtctg

SEQ ID NO: 15314 - DNA, 13 bp, Artificial Sequence
  synthetic sequence
ctttaagatgtgc

SEQ ID NO: 15315 - DNA, 13 bp, Artificial Sequence
  synthetic sequence
atatattagaacg

SEQ ID NO: 15316 - DNA, 13 bp, Artificial Sequence
  synthetic sequence
gaacgacagcacc

SEQ ID NO: 15317 - DNA, 13 bp, Artificial Sequence
  synthetic sequence
ctgctgaaccgcg

SEQ ID NO: 15318 - DNA, 13 bp, Artificial Sequence
  synthetic sequence
ggagagagcgaga

SEQ ID NO: 15319 - DNA, 13 bp, Artificial Sequence
  synthetic sequence
ggtaattcctaca

SEQ ID NO: 15320 - DNA, 13 bp, Artificial Sequence
  synthetic sequence
caatcatctaccc

SEQ ID NO: 15321 - DNA, 13 bp, Artificial Sequence
  synthetic sequence
cgttacagggcat

SEQ ID NO: 15322 - DNA, 13 bp, Artificial Sequence
  synthetic sequence
actgggcctcgaa

SEQ ID NO: 15323 - DNA, 13 bp, Artificial Sequence
  synthetic sequence
acgtcttattcac

SEQ ID NO: 15324 - DNA, 13 bp, Artificial Sequence
  synthetic sequence
ctttaaatccgac

SEQ ID NO: 15325 - DNA, 13 bp, Artificial Sequence
  synthetic sequence
ttctgttgtttgg

SEQ ID NO: 15326 - DNA, 13 bp, Artificial Sequence
  synthetic sequence
gttcggcccttcg

SEQ ID NO: 15327 - DNA, 13 bp, Artificial Sequence
  synthetic sequence
acaaggtttagca

SEQ ID NO: 15328 - DNA, 13 bp, Artificial Sequence
  synthetic sequence
gccggatagcgtt

SEQ ID NO: 15329 - DNA, 13 bp, Artificial Sequence
  synthetic sequence
agattatacagat

SEQ ID NO: 15330 - DNA, 13 bp, Artificial Sequence
  synthetic sequence
cgtcgcacacaag

SEQ ID NO: 15331 - DNA, 13 bp, Artificial Sequence
  synthetic sequence
attggtcatgatg

SEQ ID NO: 15332 - DNA, 13 bp, Artificial Sequence
  synthetic sequence
gtaagctgacgta

SEQ ID NO: 15333 - DNA, 13 bp, Artificial Sequence
  synthetic sequence
cggtcagtggctt

SEQ ID NO: 15334 - DNA, 13 bp, Artificial Sequence
  synthetic sequence
tgggctttgtgaa

SEQ ID NO: 15335 - DNA, 13 bp, Artificial Sequence
  synthetic sequence
ggcttcttcggtt

SEQ ID NO: 15336 - DNA, 13 bp, Artificial Sequence
  synthetic sequence
ccgtgctgagcga

SEQ ID NO: 15337 - DNA, 13 bp, Artificial Sequence
  synthetic sequence
ctcgcatctcccc

SEQ ID NO: 15338 - DNA, 13 bp, Artificial Sequence
  synthetic sequence
gcaaacagagtca

SEQ ID NO: 15339 - DNA, 13 bp, Artificial Sequence
  synthetic sequence
tacgtgaggcgac

SEQ ID NO: 15340 - DNA, 13 bp, Artificial Sequence
  synthetic sequence
agacggcgtacag

SEQ ID NO: 15341 - DNA, 13 bp, Artificial Sequence
  synthetic sequence
acttcgggccgta

SEQ ID NO: 15342 - DNA, 13 bp, Artificial Sequence
  synthetic sequence
atcagtcaaactg

SEQ ID NO: 15343 - DNA, 13 bp, Artificial Sequence
  synthetic sequence
ccgattgatcatc

SEQ ID NO: 15344 - DNA, 13 bp, Artificial Sequence
  synthetic sequence
tcgtaaacgatgc

SEQ ID NO: 15345 - DNA, 13 bp, Artificial Sequence
  synthetic sequence
cttttggatcagc

SEQ ID NO: 15346 - DNA, 13 bp, Artificial Sequence
  synthetic sequence
tgtttcattcttt

SEQ ID NO: 15347 - DNA, 13 bp, Artificial Sequence
  synthetic sequence
acttctttctgag

SEQ ID NO: 15348 - DNA, 13 bp, Artificial Sequence
  synthetic sequence
gtaccaccaggct

SEQ ID NO: 15349 - DNA, 13 bp, Artificial Sequence
  synthetic sequence
cacgcccaagtac

SEQ ID NO: 15350 - DNA, 13 bp, Artificial Sequence
  synthetic sequence
gtttgtgcctagt

SEQ ID NO: 15351 - DNA, 13 bp, Artificial Sequence
  synthetic sequence
tggcgtattgcct

SEQ ID NO: 15352 - DNA, 13 bp, Artificial Sequence
  synthetic sequence
gcctacgagccca

SEQ ID NO: 15353 - DNA, 13 bp, Artificial Sequence
  synthetic sequence
tcaggagtagcac

SEQ ID NO: 15354 - DNA, 13 bp, Artificial Sequence
  synthetic sequence
aggttagtacaag

SEQ ID NO: 15355 - DNA, 13 bp, Artificial Sequence
  synthetic sequence
tactgtttgcaga

SEQ ID NO: 15356 - DNA, 13 bp, Artificial Sequence
  synthetic sequence
cgtcaaaagacaa

SEQ ID NO: 15357 - DNA, 13 bp, Artificial Sequence
  synthetic sequence
caacaaggcgcgg

SEQ ID NO: 15358 - DNA, 13 bp, Artificial Sequence
  synthetic sequence
gctgacgcccgta

SEQ ID NO: 15359 - DNA, 13 bp, Artificial Sequence
  synthetic sequence
tgggaagcagtga

SEQ ID NO: 15360 - DNA, 13 bp, Artificial Sequence
  synthetic sequence
ttgaggcacagac

SEQ ID NO: 15361 - DNA, 13 bp, Artificial Sequence
  synthetic sequence
tgctttgctggca

SEQ ID NO: 15362 - DNA, 13 bp, Artificial Sequence
  synthetic sequence
gctgttgtgcagc

SEQ ID NO: 15363 - DNA, 13 bp, Artificial Sequence
  synthetic sequence
agcgaacgttgag

SEQ ID NO: 15364 - DNA, 13 bp, Artificial Sequence
  synthetic sequence
atgtataagaact

SEQ ID NO: 15365 - DNA, 13 bp, Artificial Sequence
  synthetic sequence
ttactctaacatt

SEQ ID NO: 15366 - DNA, 13 bp, Artificial Sequence
  synthetic sequence
ctcctcggtgcat

SEQ ID NO: 15367 - DNA, 13 bp, Artificial Sequence
  synthetic sequence
ttcgcgctccgga

SEQ ID NO: 15368 - DNA, 13 bp, Artificial Sequence
  synthetic sequence
atacgagaagatg

SEQ ID NO: 15369 - DNA, 13 bp, Artificial Sequence
  synthetic sequence
acaaatgacaacg

SEQ ID NO: 15370 - DNA, 13 bp, Artificial Sequence
  synthetic sequence
ttttctttccaaa

SEQ ID NO: 15371 - DNA, 13 bp, Artificial Sequence
  synthetic sequence
acgattttagccg

SEQ ID NO: 15372 - DNA, 13 bp, Artificial Sequence
  synthetic sequence
aagctgcgcctct

SEQ ID NO: 15373 - DNA, 13 bp, Artificial Sequence
  synthetic sequence
ataaggatgccaa

SEQ ID NO: 15374 - DNA, 13 bp, Artificial Sequence
  synthetic sequence
cgcatggcagaag

SEQ ID NO: 15375 - DNA, 13 bp, Artificial Sequence
  synthetic sequence
gacaatcaacagc

SEQ ID NO: 15376 - DNA, 13 bp, Artificial Sequence
  synthetic sequence
acgttcaggtgcc

SEQ ID NO: 15377 - DNA, 13 bp, Artificial Sequence
  synthetic sequence
ccgattgctcggc

SEQ ID NO: 15378 - DNA, 13 bp, Artificial Sequence
  synthetic sequence
cctgctagcagcc

SEQ ID NO: 15379 - DNA, 13 bp, Artificial Sequence
  synthetic sequence
ggaacaggccgag

SEQ ID NO: 15380 - DNA, 13 bp, Artificial Sequence
  synthetic sequence
atctcaatgatat

SEQ ID NO: 15381 - DNA, 13 bp, Artificial Sequence
  synthetic sequence
ctattaacaaaga

SEQ ID NO: 15382 - DNA, 13 bp, Artificial Sequence
  synthetic sequence
agtcacgaccgcc

SEQ ID NO: 15383 - DNA, 13 bp, Artificial Sequence
  synthetic sequence
ccaacggcacgct

SEQ ID NO: 15384 - DNA, 13 bp, Artificial Sequence
  synthetic sequence
tcgactggtgcct

SEQ ID NO: 15385 - DNA, 13 bp, Artificial Sequence
  synthetic sequence
acggtgagtggct

SEQ ID NO: 15386 - DNA, 13 bp, Artificial Sequence
  synthetic sequence
caaatgccatccc

SEQ ID NO: 15387 - DNA, 13 bp, Artificial Sequence
  synthetic sequence
gagcgttattatc

SEQ ID NO: 15388 - DNA, 13 bp, Artificial Sequence
  synthetic sequence
gccataatccttt

SEQ ID NO: 15389 - DNA, 13 bp, Artificial Sequence
  synthetic sequence
gaagtatatcagt

SEQ ID NO: 15390 - DNA, 13 bp, Artificial Sequence
  synthetic sequence
ttccgccagttcc

SEQ ID NO: 15391 - DNA, 13 bp, Artificial Sequence
  synthetic sequence
aacataccgggca

SEQ ID NO: 15392 - DNA, 13 bp, Artificial Sequence
  synthetic sequence
atgcggcaagtca

SEQ ID NO: 15393 - DNA, 13 bp, Artificial Sequence
  synthetic sequence
ccatgccaatcgg

SEQ ID NO: 15394 - DNA, 13 bp, Artificial Sequence
  synthetic sequence
gagaaaagagata

SEQ ID NO: 15395 - DNA, 13 bp, Artificial Sequence
  synthetic sequence
cgtcaacgacacg

SEQ ID NO: 15396 - DNA, 13 bp, Artificial Sequence
  synthetic sequence
ttgatgcaggaaa

SEQ ID NO: 15397 - DNA, 13 bp, Artificial Sequence
  synthetic sequence
agaacgccatctt

SEQ ID NO: 15398 - DNA, 13 bp, Artificial Sequence
  synthetic sequence
agtccaaactaaa

SEQ ID NO: 15399 - DNA, 13 bp, Artificial Sequence
  synthetic sequence
tgctaaagcacgg

SEQ ID NO: 15400 - DNA, 13 bp, Artificial Sequence
  synthetic sequence
actgcaacagaac

SEQ ID NO: 15401 - DNA, 13 bp, Artificial Sequence
  synthetic sequence
ctcatagacaagt

SEQ ID NO: 15402 - DNA, 13 bp, Artificial Sequence
  synthetic sequence
gtggtccgcctct

SEQ ID NO: 15403 - DNA, 13 bp, Artificial Sequence
  synthetic sequence
aaggttttacaga

SEQ ID NO: 15404 - DNA, 13 bp, Artificial Sequence
  synthetic sequence
cagcatccagcgg

SEQ ID NO: 15405 - DNA, 13 bp, Artificial Sequence
  synthetic sequence
gctccagttcgtc

SEQ ID NO: 15406 - DNA, 13 bp, Artificial Sequence
  synthetic sequence
tcttcaatgccat

SEQ ID NO: 15407 - DNA, 13 bp, Artificial Sequence
  synthetic sequence
gccaaatatcata

SEQ ID NO: 15408 - DNA, 13 bp, Artificial Sequence
  synthetic sequence
acttgaagagatc

SEQ ID NO: 15409 - DNA, 13 bp, Artificial Sequence
  synthetic sequence
aacgctgcttgag

SEQ ID NO: 15410 - DNA, 13 bp, Artificial Sequence
  synthetic sequence
cgccgccaaatcc

SEQ ID NO: 15411 - DNA, 13 bp, Artificial Sequence
  synthetic sequence
cgactcgccgatg

SEQ ID NO: 15412 - DNA, 13 bp, Artificial Sequence
  synthetic sequence
aacaaaccaatac

SEQ ID NO: 15413 - DNA, 13 bp, Artificial Sequence
  synthetic sequence
tgaatggtgaaat

SEQ ID NO: 15414 - DNA, 13 bp, Artificial Sequence
  synthetic sequence
atccacgccgaag

SEQ ID NO: 15415 - DNA, 13 bp, Artificial Sequence
  synthetic sequence
gtcgctgaccgca

SEQ ID NO: 15416 - DNA, 13 bp, Artificial Sequence
  synthetic sequence
ttgcctaccacga

SEQ ID NO: 15417 - DNA, 13 bp, Artificial Sequence
  synthetic sequence
acaatcgccaggc

SEQ ID NO: 15418 - DNA, 13 bp, Artificial Sequence
  synthetic sequence
gcggcgttcgcta

SEQ ID NO: 15419 - DNA, 13 bp, Artificial Sequence
  synthetic sequence
ctatcacaggcac

SEQ ID NO: 15420 - DNA, 13 bp, Artificial Sequence
  synthetic sequence
cccagatggatgc

SEQ ID NO: 15421 - DNA, 13 bp, Artificial Sequence
  synthetic sequence
cctgtgaaaatga

SEQ ID NO: 15422 - DNA, 13 bp, Artificial Sequence
  synthetic sequence
acgcggtcgagat

SEQ ID NO: 15423 - DNA, 13 bp, Artificial Sequence
  synthetic sequence
agataccgtggct

SEQ ID NO: 15424 - DNA, 13 bp, Artificial Sequence
  synthetic sequence
tgtcgcgaaggca

SEQ ID NO: 15425 - DNA, 13 bp, Artificial Sequence
  synthetic sequence
tgcgtgtacgtcc

SEQ ID NO: 15426 - DNA, 13 bp, Artificial Sequence
  synthetic sequence
cagctggttgcgc

SEQ ID NO: 15427 - DNA, 13 bp, Artificial Sequence
  synthetic sequence
ttagtgtagagca

SEQ ID NO: 15428 - DNA, 13 bp, Artificial Sequence
  synthetic sequence
tcgctctctccag

SEQ ID NO: 15429 - DNA, 13 bp, Artificial Sequence
  synthetic sequence
acccgctcgacta

SEQ ID NO: 15430 - DNA, 13 bp, Artificial Sequence
  synthetic sequence
gtgacgctgaata

SEQ ID NO: 15431 - DNA, 13 bp, Artificial Sequence
  synthetic sequence
aaatcggcgtttt

SEQ ID NO: 15432 - DNA, 13 bp, Artificial Sequence
  synthetic sequence
ccgataggcagcc

SEQ ID NO: 15433 - DNA, 13 bp, Artificial Sequence
  synthetic sequence
tggctcagctgga

SEQ ID NO: 15434 - DNA, 13 bp, Artificial Sequence
  synthetic sequence
caaaggttgccct

SEQ ID NO: 15435 - DNA, 13 bp, Artificial Sequence
  synthetic sequence
tcacttcgttcgc

SEQ ID NO: 15436 - DNA, 13 bp, Artificial Sequence
  synthetic sequence
ggtgatcgccgac

SEQ ID NO: 15437 - DNA, 13 bp, Artificial Sequence
  synthetic sequence
ttcggtcagctcg

SEQ ID NO: 15438 - DNA, 13 bp, Artificial Sequence
  synthetic sequence
gtcgattgagctg

SEQ ID NO: 15439 - DNA, 13 bp, Artificial Sequence
  synthetic sequence
ccatggcggggat

SEQ ID NO: 15440 - DNA, 13 bp, Artificial Sequence
  synthetic sequence
ctgttgcaaagcc

SEQ ID NO: 15441 - DNA, 13 bp, Artificial Sequence
  synthetic sequence
ggtacaagatata

SEQ ID NO: 15442 - DNA, 13 bp, Artificial Sequence
  synthetic sequence
cgttcatcgtcag

SEQ ID NO: 15443 - DNA, 13 bp, Artificial Sequence
  synthetic sequence
gctgcgccgtaac

SEQ ID NO: 15444 - DNA, 13 bp, Artificial Sequence
  synthetic sequence
gcgagttaaacac

SEQ ID NO: 15445 - DNA, 13 bp, Artificial Sequence
  synthetic sequence
tcactttgaacat

SEQ ID NO: 15446 - DNA, 13 bp, Artificial Sequence
  synthetic sequence
ggccaggtcatca

SEQ ID NO: 15447 - DNA, 13 bp, Artificial Sequence
  synthetic sequence
tgaaagagcctgg

SEQ ID NO: 15448 - DNA, 13 bp, Artificial Sequence
  synthetic sequence
ccgatctgggtga

SEQ ID NO: 15449 - DNA, 13 bp, Artificial Sequence
  synthetic sequence
taagcgtcccaga

SEQ ID NO: 15450 - DNA, 13 bp, Artificial Sequence
  synthetic sequence
caagcggcgctat

SEQ ID NO: 15451 - DNA, 13 bp, Artificial Sequence
  synthetic sequence
atatgaacagtat

SEQ ID NO: 15452 - DNA, 13 bp, Artificial Sequence
  synthetic sequence
ctcattagagcaa

SEQ ID NO: 15453 - DNA, 13 bp, Artificial Sequence
  synthetic sequence
catcgatacgccg

SEQ ID NO: 15454 - DNA, 13 bp, Artificial Sequence
  synthetic sequence
gtgcctttccagg

SEQ ID NO: 15455 - DNA, 13 bp, Artificial Sequence
  synthetic sequence
ctgtgaaaccgcc

SEQ ID NO: 15456 - DNA, 13 bp, Artificial Sequence
  synthetic sequence
gccgattggtgct

SEQ ID NO: 15457 - DNA, 13 bp, Artificial Sequence
  synthetic sequence
tctctggcactga

SEQ ID NO: 15458 - DNA, 13 bp, Artificial Sequence
  synthetic sequence
tcctgaagcgcat

SEQ ID NO: 15459 - DNA, 13 bp, Artificial Sequence
  synthetic sequence
acggcagaagagc

SEQ ID NO: 15460 - DNA, 13 bp, Artificial Sequence
  synthetic sequence
tccagcatttcca

SEQ ID NO: 15461 - DNA, 13 bp, Artificial Sequence
  synthetic sequence
gatggcaaggcac

SEQ ID NO: 15462 - DNA, 13 bp, Artificial Sequence
  synthetic sequence
tctcggtctacgc

SEQ ID NO: 15463 - DNA, 13 bp, Artificial Sequence
  synthetic sequence
ggcctttcaccgg

SEQ ID NO: 15464 - DNA, 13 bp, Artificial Sequence
  synthetic sequence
tcaaccaactaaa

SEQ ID NO: 15465 - DNA, 13 bp, Artificial Sequence
  synthetic sequence
gacggtaaagcgg

SEQ ID NO: 15466 - DNA, 13 bp, Artificial Sequence
  synthetic sequence
tatggctcgccgc

SEQ ID NO: 15467 - DNA, 13 bp, Artificial Sequence
  synthetic sequence
ggtaagctcggtg

SEQ ID NO: 15468 - DNA, 13 bp, Artificial Sequence
  synthetic sequence
actcaaacctatg

SEQ ID NO: 15469 - DNA, 13 bp, Artificial Sequence
  synthetic sequence
gatgtcctgcagc

SEQ ID NO: 15470 - DNA, 13 bp, Artificial Sequence
  synthetic sequence
cgcaaacctgctt

SEQ ID NO: 15471 - DNA, 13 bp, Artificial Sequence
  synthetic sequence
acccttcacctaa

SEQ ID NO: 15472 - DNA, 13 bp, Artificial Sequence
  synthetic sequence
acgtagagcgctg

SEQ ID NO: 15473 - DNA, 13 bp, Artificial Sequence
  synthetic sequence
acctaatatggct

SEQ ID NO: 15474 - DNA, 13 bp, Artificial Sequence
  synthetic sequence
tcatatcatgacc

SEQ ID NO: 15475 - DNA, 13 bp, Artificial Sequence
  synthetic sequence
tgccgatcatcag

SEQ ID NO: 15476 - DNA, 13 bp, Artificial Sequence
  synthetic sequence
ttaagagaagaac

SEQ ID NO: 15477 - DNA, 13 bp, Artificial Sequence
  synthetic sequence
gatacactacata

SEQ ID NO: 15478 - DNA, 13 bp, Artificial Sequence
  synthetic sequence
aggggcatcatga

SEQ ID NO: 15479 - DNA, 13 bp, Artificial Sequence
  synthetic sequence
ccgcgactggaac

SEQ ID NO: 15480 - DNA, 13 bp, Artificial Sequence
  synthetic sequence
aagctttacggcc

SEQ ID NO: 15481 - DNA, 13 bp, Artificial Sequence
  synthetic sequence
gacatggtgccac

SEQ ID NO: 15482 - DNA, 13 bp, Artificial Sequence
  synthetic sequence
cggctcggtcatt

SEQ ID NO: 15483 - DNA, 13 bp, Artificial Sequence
  synthetic sequence
gcctacgcctatg

SEQ ID NO: 15484 - DNA, 13 bp, Artificial Sequence
  synthetic sequence
gcttcacctaaaa

SEQ ID NO: 15485 - DNA, 13 bp, Artificial Sequence
  synthetic sequence
taaatccagccag

SEQ ID NO: 15486 - DNA, 13 bp, Artificial Sequence
  synthetic sequence
ccaagcatcgact

SEQ ID NO: 15487 - DNA, 13 bp, Artificial Sequence
  synthetic sequence
aatatcagtactg

SEQ ID NO: 15488 - DNA, 13 bp, Artificial Sequence
  synthetic sequence
gttgtaacgttca

SEQ ID NO: 15489 - DNA, 13 bp, Artificial Sequence
  synthetic sequence
ggatgccttaaca

SEQ ID NO: 15490 - DNA, 13 bp, Artificial Sequence
  synthetic sequence
ttggtggtgcaat

SEQ ID NO: 15491 - DNA, 13 bp, Artificial Sequence
  synthetic sequence
atgcccggcaaat

SEQ ID NO: 15492 - DNA, 13 bp, Artificial Sequence
  synthetic sequence
accctattaactt

SEQ ID NO: 15493 - DNA, 13 bp, Artificial Sequence
  synthetic sequence
atcagcaagaacc

SEQ ID NO: 15494 - DNA, 13 bp, Artificial Sequence
  synthetic sequence
cacaggcgcaaca

SEQ ID NO: 15495 - DNA, 13 bp, Artificial Sequence
  synthetic sequence
ttgcggcgcaaaa

SEQ ID NO: 15496 - DNA, 13 bp, Artificial Sequence
  synthetic sequence
tattatctacagc

SEQ ID NO: 15497 - DNA, 13 bp, Artificial Sequence
  synthetic sequence
tggtcgaaacctc

SEQ ID NO: 15498 - DNA, 13 bp, Artificial Sequence
  synthetic sequence
gactgtaattctg

SEQ ID NO: 15499 - DNA, 13 bp, Artificial Sequence
  synthetic sequence
cttagatcagcaa

SEQ ID NO: 15500 - DNA, 13 bp, Artificial Sequence
  synthetic sequence
ggaattggctacc

SEQ ID NO: 15501 - DNA, 13 bp, Artificial Sequence
  synthetic sequence
tgatctgaaagta

SEQ ID NO: 15502 - DNA, 13 bp, Artificial Sequence
  synthetic sequence
accagcacgagat

SEQ ID NO: 15503 - DNA, 13 bp, Artificial Sequence
  synthetic sequence
acatgaccgcctc

SEQ ID NO: 15504 - DNA, 13 bp, Artificial Sequence
  synthetic sequence
acgacttcacgac

SEQ ID NO: 15505 - DNA, 13 bp, Artificial Sequence
  synthetic sequence
cccttggtgggtc

SEQ ID NO: 15506 - DNA, 13 bp, Artificial Sequence
  synthetic sequence
tgctgcagggctg

SEQ ID NO: 15507 - DNA, 13 bp, Artificial Sequence
  synthetic sequence
agtggatctacgg

SEQ ID NO: 15508 - DNA, 13 bp, Artificial Sequence
  synthetic sequence
tgcccgcgaacat

SEQ ID NO: 15509 - DNA, 13 bp, Artificial Sequence
  synthetic sequence
cggtaagctgtct

SEQ ID NO: 15510 - DNA, 13 bp, Artificial Sequence
  synthetic sequence
ggcctgcatacac

SEQ ID NO: 15511 - DNA, 13 bp, Artificial Sequence
  synthetic sequence
ctcggggttgtca

SEQ ID NO: 15512 - DNA, 13 bp, Artificial Sequence
  synthetic sequence
ataccattgatgt

SEQ ID NO: 15513 - DNA, 13 bp, Artificial Sequence
  synthetic sequence
gatatcgcgagcc

SEQ ID NO: 15514 - DNA, 13 bp, Artificial Sequence
  synthetic sequence
atcttggcggcac

SEQ ID NO: 15515 - DNA, 13 bp, Artificial Sequence
  synthetic sequence
tacccgtcggttt

SEQ ID NO: 15516 - DNA, 13 bp, Artificial Sequence
  synthetic sequence
tcaccgctaccgt

SEQ ID NO: 15517 - DNA, 13 bp, Artificial Sequence
  synthetic sequence
tggtcttgagccg

SEQ ID NO: 15518 - DNA, 13 bp, Artificial Sequence
  synthetic sequence
actatatttctgg

SEQ ID NO: 15519 - DNA, 13 bp, Artificial Sequence
  synthetic sequence
gtagacacgaaag

SEQ ID NO: 15520 - DNA, 13 bp, Artificial Sequence
  synthetic sequence
catagagatgata

SEQ ID NO: 15521 - DNA, 13 bp, Artificial Sequence
  synthetic sequence
cctttatcggttt

SEQ ID NO: 15522 - DNA, 13 bp, Artificial Sequence
  synthetic sequence
cagcgtttgctgc

SEQ ID NO: 15523 - DNA, 13 bp, Artificial Sequence
  synthetic sequence
ggcttatcgcatc

SEQ ID NO: 15524 - DNA, 13 bp, Artificial Sequence
  synthetic sequence
atcacccagctta

SEQ ID NO: 15525 - DNA, 13 bp, Artificial Sequence
  synthetic sequence
cctggccgtctac

SEQ ID NO: 15526 - DNA, 13 bp, Artificial Sequence
  synthetic sequence
tagccatcttgtt

SEQ ID NO: 15527 - DNA, 13 bp, Artificial Sequence
  synthetic sequence
tatgattggatgt

SEQ ID NO: 15528 - DNA, 13 bp, Artificial Sequence
  synthetic sequence
ccgccttgtaata

SEQ ID NO: 15529 - DNA, 13 bp, Artificial Sequence
  synthetic sequence
ggaataccagcaa

SEQ ID NO: 15530 - DNA, 13 bp, Artificial Sequence
  synthetic sequence
tgatattagtgta

SEQ ID NO: 15531 - DNA, 13 bp, Artificial Sequence
  synthetic sequence
tggactcggtgtt

SEQ ID NO: 15532 - DNA, 13 bp, Artificial Sequence
  synthetic sequence
acccatagtttca

SEQ ID NO: 15533 - DNA, 13 bp, Artificial Sequence
  synthetic sequence
tatgccgcaccca

SEQ ID NO: 15534 - DNA, 13 bp, Artificial Sequence
  synthetic sequence
ataaagcccttgc

SEQ ID NO: 15535 - DNA, 13 bp, Artificial Sequence
  synthetic sequence
tttatgtgcaatt

SEQ ID NO: 15536 - DNA, 13 bp, Artificial Sequence
  synthetic sequence
gccttacggtggc

SEQ ID NO: 15537 - DNA, 13 bp, Artificial Sequence
  synthetic sequence
caggaggtccttc

SEQ ID NO: 15538 - DNA, 13 bp, Artificial Sequence
  synthetic sequence
ctgcgttcgaccc

SEQ ID NO: 15539 - DNA, 13 bp, Artificial Sequence
  synthetic sequence
cgcttcgctcgac

SEQ ID NO: 15540 - DNA, 13 bp, Artificial Sequence
  synthetic sequence
ccttcttctacag

SEQ ID NO: 15541 - DNA, 13 bp, Artificial Sequence
  synthetic sequence
ttttgacggctgc

SEQ ID NO: 15542 - DNA, 13 bp, Artificial Sequence
  synthetic sequence
caccatcccgaac

SEQ ID NO: 15543 - DNA, 13 bp, Artificial Sequence
  synthetic sequence
aaatcaggatttt

SEQ ID NO: 15544 - DNA, 13 bp, Artificial Sequence
  synthetic sequence
atacctgaataat

SEQ ID NO: 15545 - DNA, 13 bp, Artificial Sequence
  synthetic sequence
ataaaactagaag

SEQ ID NO: 15546 - DNA, 13 bp, Artificial Sequence
  synthetic sequence
gacctttgccgtc

SEQ ID NO: 15547 - DNA, 13 bp, Artificial Sequence
  synthetic sequence
agaaagtcatcat

SEQ ID NO: 15548 - DNA, 13 bp, Artificial Sequence
  synthetic sequence
gaatcgaccagct

SEQ ID NO: 15549 - DNA, 13 bp, Artificial Sequence
  synthetic sequence
gcatctcccagcc

SEQ ID NO: 15550 - DNA, 13 bp, Artificial Sequence
  synthetic sequence
ccatcgttggcaa

SEQ ID NO: 15551 - DNA, 13 bp, Artificial Sequence
  synthetic sequence
ctttatcagataa

SEQ ID NO: 15552 - DNA, 13 bp, Artificial Sequence
  synthetic sequence
tcatttggatcat

SEQ ID NO: 15553 - DNA, 13 bp, Artificial Sequence
  synthetic sequence
gtcagcgagttga

SEQ ID NO: 15554 - DNA, 13 bp, Artificial Sequence
  synthetic sequence
tatacttgccttt

SEQ ID NO: 15555 - DNA, 13 bp, Artificial Sequence
  synthetic sequence
cgtcgaaaccatc

SEQ ID NO: 15556 - DNA, 13 bp, Artificial Sequence
  synthetic sequence
gactgattgttag

SEQ ID NO: 15557 - DNA, 13 bp, Artificial Sequence
  synthetic sequence
atccagatacgca

SEQ ID NO: 15558 - DNA, 13 bp, Artificial Sequence
  synthetic sequence
acatcccaatctc

SEQ ID NO: 15559 - DNA, 13 bp, Artificial Sequence
  synthetic sequence
ccatcattggcaa

SEQ ID NO: 15560 - DNA, 13 bp, Artificial Sequence
  synthetic sequence
ggtctcagcagtc

SEQ ID NO: 15561 - DNA, 13 bp, Artificial Sequence
  synthetic sequence
cgtcccaatctcg

SEQ ID NO: 15562 - DNA, 13 bp, Artificial Sequence
  synthetic sequence
atccatctgagtt

SEQ ID NO: 15563 - DNA, 13 bp, Artificial Sequence
  synthetic sequence
ccgaacagcgaca

SEQ ID NO: 15564 - DNA, 13 bp, Artificial Sequence
  synthetic sequence
ttcgctgtctgcc

SEQ ID NO: 15565 - DNA, 13 bp, Artificial Sequence
  synthetic sequence
gataaccagcggc

SEQ ID NO: 15566 - DNA, 13 bp, Artificial Sequence
  synthetic sequence
cgcccatgatgaa

SEQ ID NO: 15567 - DNA, 13 bp, Artificial Sequence
  synthetic sequence
ggaatttcttcta

SEQ ID NO: 15568 - DNA, 13 bp, Artificial Sequence
  synthetic sequence
acgacttcaaccg

SEQ ID NO: 15569 - DNA, 13 bp, Artificial Sequence
  synthetic sequence
ttaactcactact

SEQ ID NO: 15570 - DNA, 13 bp, Artificial Sequence
  synthetic sequence
attcttgaataca

SEQ ID NO: 15571 - DNA, 13 bp, Artificial Sequence
  synthetic sequence
cccacacctaaat

SEQ ID NO: 15572 - DNA, 13 bp, Artificial Sequence
  synthetic sequence
acagattttacag

SEQ ID NO: 15573 - DNA, 13 bp, Artificial Sequence
  synthetic sequence
ttcctggtgatgt

SEQ ID NO: 15574 - DNA, 13 bp, Artificial Sequence
  synthetic sequence
atgtactttcctt

SEQ ID NO: 15575 - DNA, 13 bp, Artificial Sequence
  synthetic sequence
gatggcgttcttc

SEQ ID NO: 15576 - DNA, 13 bp, Artificial Sequence
  synthetic sequence
ccaacgttacttg

SEQ ID NO: 15577 - DNA, 13 bp, Artificial Sequence
  synthetic sequence
tcctcgatctgca

SEQ ID NO: 15578 - DNA, 13 bp, Artificial Sequence
  synthetic sequence
cagtttcatgaaa

SEQ ID NO: 15579 - DNA, 13 bp, Artificial Sequence
  synthetic sequence
gttcctgttccca

SEQ ID NO: 15580 - DNA, 13 bp, Artificial Sequence
  synthetic sequence
tacgcacaccgat

SEQ ID NO: 15581 - DNA, 13 bp, Artificial Sequence
  synthetic sequence
gcgtgggtgatcg

SEQ ID NO: 15582 - DNA, 13 bp, Artificial Sequence
  synthetic sequence
ctttctgcgtacg

SEQ ID NO: 15583 - DNA, 13 bp, Artificial Sequence
  synthetic sequence
attaggcagtaag

SEQ ID NO: 15584 - DNA, 13 bp, Artificial Sequence
  synthetic sequence
caaactatagcaa

SEQ ID NO: 15585 - DNA, 13 bp, Artificial Sequence
  synthetic sequence
accatctgaccat

SEQ ID NO: 15586 - DNA, 13 bp, Artificial Sequence
  synthetic sequence
ggccgatcttcgc

SEQ ID NO: 15587 - DNA, 13 bp, Artificial Sequence
  synthetic sequence
ctcctttcaaaat

SEQ ID NO: 15588 - DNA, 13 bp, Artificial Sequence
  synthetic sequence
ccatgccgaacat

SEQ ID NO: 15589 - DNA, 13 bp, Artificial Sequence
  synthetic sequence
accttatctatac

SEQ ID NO: 15590 - DNA, 13 bp, Artificial Sequence
  synthetic sequence
agcccgctccaag

SEQ ID NO: 15591 - DNA, 13 bp, Artificial Sequence
  synthetic sequence
gttacatacaaga

SEQ ID NO: 15592 - DNA, 13 bp, Artificial Sequence
  synthetic sequence
caagaatgcgcca

SEQ ID NO: 15593 - DNA, 13 bp, Artificial Sequence
  synthetic sequence
accagcgcgcctt

SEQ ID NO: 15594 - DNA, 13 bp, Artificial Sequence
  synthetic sequence
ttctgcggatcga

SEQ ID NO: 15595 - DNA, 13 bp, Artificial Sequence
  synthetic sequence
gcggtcttgttcg

SEQ ID NO: 15596 - DNA, 13 bp, Artificial Sequence
  synthetic sequence
atctctgtgattt

SEQ ID NO: 15597 - DNA, 13 bp, Artificial Sequence
  synthetic sequence
ttgcctctgcaat

SEQ ID NO: 15598 - DNA, 13 bp, Artificial Sequence
  synthetic sequence
agttctacaagca

SEQ ID NO: 15599 - DNA, 13 bp, Artificial Sequence
  synthetic sequence
cttcagccgcctc

SEQ ID NO: 15600 - DNA, 13 bp, Artificial Sequence
  synthetic sequence
ggcaccatctcgc

SEQ ID NO: 15601 - DNA, 13 bp, Artificial Sequence
  synthetic sequence
gccggcttgttgt

SEQ ID NO: 15602 - DNA, 13 bp, Artificial Sequence
  synthetic sequence
accagctctcata

SEQ ID NO: 15603 - DNA, 13 bp, Artificial Sequence
  synthetic sequence
aggaacacgagca

SEQ ID NO: 15604 - DNA, 13 bp, Artificial Sequence
  synthetic sequence
tagcatctcccat

SEQ ID NO: 15605 - DNA, 13 bp, Artificial Sequence
  synthetic sequence
ccatcttcatttt

SEQ ID NO: 15606 - DNA, 13 bp, Artificial Sequence
  synthetic sequence
agccagatacgca

SEQ ID NO: 15607 - DNA, 13 bp, Artificial Sequence
  synthetic sequence
tataaattttggc

SEQ ID NO: 15608 - DNA, 13 bp, Artificial Sequence
  synthetic sequence
ctgggtctccatg

SEQ ID NO: 15609 - DNA, 13 bp, Artificial Sequence
  synthetic sequence
ctgcgtggcaaaa

SEQ ID NO: 15610 - DNA, 13 bp, Artificial Sequence
  synthetic sequence
ggcctgctcatag

SEQ ID NO: 15611 - DNA, 13 bp, Artificial Sequence
  synthetic sequence
aaaggcgaatata

SEQ ID NO: 15612 - DNA, 13 bp, Artificial Sequence
  synthetic sequence
atgttacgcagca

SEQ ID NO: 15613 - DNA, 13 bp, Artificial Sequence
  synthetic sequence
gcgatatactttt

SEQ ID NO: 15614 - DNA, 13 bp, Artificial Sequence
  synthetic sequence
accatttagcaaa

SEQ ID NO: 15615 - DNA, 13 bp, Artificial Sequence
  synthetic sequence
aacgtttgaaata

SEQ ID NO: 15616 - DNA, 13 bp, Artificial Sequence
  synthetic sequence
gcaggatgtcgtc

SEQ ID NO: 15617 - DNA, 13 bp, Artificial Sequence
  synthetic sequence
aatcttacagtcc

SEQ ID NO: 15618 - DNA, 13 bp, Artificial Sequence
  synthetic sequence
tgtcctatcagga

SEQ ID NO: 15619 - DNA, 13 bp, Artificial Sequence
  synthetic sequence
tggaccgacctga

SEQ ID NO: 15620 - DNA, 13 bp, Artificial Sequence
  synthetic sequence
taaatatttcctg

SEQ ID NO: 15621 - DNA, 13 bp, Artificial Sequence
  synthetic sequence
acttcgcctgggt

SEQ ID NO: 15622 - DNA, 13 bp, Artificial Sequence
  synthetic sequence
acacccatgatga

SEQ ID NO: 15623 - DNA, 13 bp, Artificial Sequence
  synthetic sequence
tacctgcgcctgc

SEQ ID NO: 15624 - DNA, 13 bp, Artificial Sequence
  synthetic sequence
gccagcaccagga

SEQ ID NO: 15625 - DNA, 13 bp, Artificial Sequence
  synthetic sequence
ccgacatcgaaac

SEQ ID NO: 15626 - DNA, 13 bp, Artificial Sequence
  synthetic sequence
acgactttatcga

SEQ ID NO: 15627 - DNA, 13 bp, Artificial Sequence
  synthetic sequence
gtttgaaccatgt

SEQ ID NO: 15628 - DNA, 13 bp, Artificial Sequence
  synthetic sequence
ttcgttatttaca

SEQ ID NO: 15629 - DNA, 13 bp, Artificial Sequence
  synthetic sequence
tcatcgcctcttc

SEQ ID NO: 15630 - DNA, 13 bp, Artificial Sequence
  synthetic sequence
ttgatgtttggtg

SEQ ID NO: 15631 - DNA, 13 bp, Artificial Sequence
  synthetic sequence
tggccgatctgct

SEQ ID NO: 15632 - DNA, 13 bp, Artificial Sequence
  synthetic sequence
gtgatgttctggc

SEQ ID NO: 15633 - DNA, 13 bp, Artificial Sequence
  synthetic sequence
cagctttcataca

SEQ ID NO: 15634 - DNA, 13 bp, Artificial Sequence
  synthetic sequence
caacaggtaatga

SEQ ID NO: 15635 - DNA, 13 bp, Artificial Sequence
  synthetic sequence
ttatcacttggga

SEQ ID NO: 15636 - DNA, 13 bp, Artificial Sequence
  synthetic sequence
ggttacgcgcctg

SEQ ID NO: 15637 - DNA, 13 bp, Artificial Sequence
  synthetic sequence
acaattgctaccg

SEQ ID NO: 15638 - DNA, 13 bp, Artificial Sequence
  synthetic sequence
tcaccaccatgat

SEQ ID NO: 15639 - DNA, 13 bp, Artificial Sequence
  synthetic sequence
cgtttccttgaac

SEQ ID NO: 15640 - DNA, 13 bp, Artificial Sequence
  synthetic sequence
cggcggccatgat

SEQ ID NO: 15641 - DNA, 13 bp, Artificial Sequence
  synthetic sequence
cagcgcgctgcaa

SEQ ID NO: 15642 - DNA, 13 bp, Artificial Sequence
  synthetic sequence
gggtgatgcggtt

SEQ ID NO: 15643 - DNA, 13 bp, Artificial Sequence
  synthetic sequence
gacgtgcgcgaac

SEQ ID NO: 15644 - DNA, 13 bp, Artificial Sequence
  synthetic sequence
tatagatcgccct

SEQ ID NO: 15645 - DNA, 13 bp, Artificial Sequence
  synthetic sequence
gtttccttggcca

SEQ ID NO: 15646 - DNA, 13 bp, Artificial Sequence
  synthetic sequence
agcaaactcattc

SEQ ID NO: 15647 - DNA, 13 bp, Artificial Sequence
  synthetic sequence
aaatgtaattggt

SEQ ID NO: 15648 - DNA, 13 bp, Artificial Sequence
  synthetic sequence
cggcgatcttcag

SEQ ID NO: 15649 - DNA, 13 bp, Artificial Sequence
  synthetic sequence
gcaaatgaagaaa

SEQ ID NO: 15650 - DNA, 13 bp, Artificial Sequence
  synthetic sequence
gggtttccataaa

SEQ ID NO: 15651 - DNA, 13 bp, Artificial Sequence
  synthetic sequence
ataaactggaaac

SEQ ID NO: 15652 - DNA, 13 bp, Artificial Sequence
  synthetic sequence
ttcaatggtatat

SEQ ID NO: 15653 - DNA, 13 bp, Artificial Sequence
  synthetic sequence
ttccatgaataga

SEQ ID NO: 15654 - DNA, 13 bp, Artificial Sequence
  synthetic sequence
ctgttcgctattg

SEQ ID NO: 15655 - DNA, 13 bp, Artificial Sequence
  synthetic sequence
aggtcgcggtcat

SEQ ID NO: 15656 - DNA, 13 bp, Artificial Sequence
  synthetic sequence
agaaccaaccaag

SEQ ID NO: 15657 - DNA, 13 bp, Artificial Sequence
  synthetic sequence
catcacgccaaac

SEQ ID NO: 15658 - DNA, 13 bp, Artificial Sequence
  synthetic sequence
gataccttaccgc

SEQ ID NO: 15659 - DNA, 13 bp, Artificial Sequence
  synthetic sequence
tcggtgcggtcca

SEQ ID NO: 15660 - DNA, 13 bp, Artificial Sequence
  synthetic sequence
tgcttaatcagtg

SEQ ID NO: 15661 - DNA, 13 bp, Artificial Sequence
  synthetic sequence
cttttgccagatt

SEQ ID NO: 15662 - DNA, 13 bp, Artificial Sequence
  synthetic sequence
cagcggattataa

SEQ ID NO: 15663 - DNA, 13 bp, Artificial Sequence
  synthetic sequence
cagacgatggcat

SEQ ID NO: 15664 - DNA, 13 bp, Artificial Sequence
  synthetic sequence
gacattcaacgcc

SEQ ID NO: 15665 - DNA, 13 bp, Artificial Sequence
  synthetic sequence
tctcgcctttcac

SEQ ID NO: 15666 - DNA, 13 bp, Artificial Sequence
  synthetic sequence
ctccatgaccagg

SEQ ID NO: 15667 - DNA, 13 bp, Artificial Sequence
  synthetic sequence
cattggaacagct

SEQ ID NO: 15668 - DNA, 13 bp, Artificial Sequence
  synthetic sequence
gtctgcgccatcg

SEQ ID NO: 15669 - DNA, 13 bp, Artificial Sequence
  synthetic sequence
cccgactagataa

SEQ ID NO: 15670 - DNA, 13 bp, Artificial Sequence
  synthetic sequence
ccatgtgcggctt

SEQ ID NO: 15671 - DNA, 13 bp, Artificial Sequence
  synthetic sequence
gcgcgagcttgat

SEQ ID NO: 15672 - DNA, 13 bp, Artificial Sequence
  synthetic sequence
acgacttcaccaa

SEQ ID NO: 15673 - DNA, 13 bp, Artificial Sequence
  synthetic sequence
accgatcgttctg

SEQ ID NO: 15674 - DNA, 13 bp, Artificial Sequence
  synthetic sequence
gcatttcccagcc

SEQ ID NO: 15675 - DNA, 13 bp, Artificial Sequence
  synthetic sequence
tatgtggtagaga

SEQ ID NO: 15676 - DNA, 13 bp, Artificial Sequence
  synthetic sequence
gggtatggttcgt

SEQ ID NO: 15677 - DNA, 13 bp, Artificial Sequence
  synthetic sequence
taaacagcctcca

SEQ ID NO: 15678 - DNA, 13 bp, Artificial Sequence
  synthetic sequence
agcttggccgggt

SEQ ID NO: 15679 - DNA, 13 bp, Artificial Sequence
  synthetic sequence
tctggcatcgcca

SEQ ID NO: 15680 - DNA, 13 bp, Artificial Sequence
  synthetic sequence
aggtgctggtgga

SEQ ID NO: 15681 - DNA, 13 bp, Artificial Sequence
  synthetic sequence
accaccacaaaga

SEQ ID NO: 15682 - DNA, 13 bp, Artificial Sequence
  synthetic sequence
cttctcggtggca

SEQ ID NO: 15683 - DNA, 13 bp, Artificial Sequence
  synthetic sequence
cgcaggttatcga

SEQ ID NO: 15684 - DNA, 13 bp, Artificial Sequence
  synthetic sequence
tgattatcacgtt

SEQ ID NO: 15685 - DNA, 13 bp, Artificial Sequence
  synthetic sequence
gctgcatctttag

SEQ ID NO: 15686 - DNA, 13 bp, Artificial Sequence
  synthetic sequence
acgatatcgctat

SEQ ID NO: 15687 - DNA, 13 bp, Artificial Sequence
  synthetic sequence
cccttcggtcacg

SEQ ID NO: 15688 - DNA, 13 bp, Artificial Sequence
  synthetic sequence
ccaagacgttcca

SEQ ID NO: 15689 - DNA, 13 bp, Artificial Sequence
  synthetic sequence
acttggtttgttc

SEQ ID NO: 15690 - DNA, 13 bp, Artificial Sequence
  synthetic sequence
ttttctttccaaa

SEQ ID NO: 15691 - DNA, 13 bp, Artificial Sequence
  synthetic sequence
tggagcaggccat

SEQ ID NO: 15692 - DNA, 13 bp, Artificial Sequence
  synthetic sequence
ggttgccacggtc

SEQ ID NO: 15693 - DNA, 13 bp, Artificial Sequence
  synthetic sequence
cgcgcgctgatga

SEQ ID NO: 15694 - DNA, 13 bp, Artificial Sequence
  synthetic sequence
tggttcccgcagg

SEQ ID NO: 15695 - DNA, 13 bp, Artificial Sequence
  synthetic sequence
tcaacacccttaa

SEQ ID NO: 15696 - DNA, 13 bp, Artificial Sequence
  synthetic sequence
catggttccataa

SEQ ID NO: 15697 - DNA, 13 bp, Artificial Sequence
  synthetic sequence
ccgatggccttct

SEQ ID NO: 15698 - DNA, 13 bp, Artificial Sequence
  synthetic sequence
ccaccttcacgcg

SEQ ID NO: 15699 - DNA, 13 bp, Artificial Sequence
  synthetic sequence
acagcacgatgtc

SEQ ID NO: 15700 - DNA, 13 bp, Artificial Sequence
  synthetic sequence
cccagcacccagt

SEQ ID NO: 15701 - DNA, 13 bp, Artificial Sequence
  synthetic sequence
aaaaccaacctgg

SEQ ID NO: 15702 - DNA, 13 bp, Artificial Sequence
  synthetic sequence
tcggtgcggtcga

SEQ ID NO: 15703 - DNA, 13 bp, Artificial Sequence
  synthetic sequence
ggaacagcgcttc

SEQ ID NO: 15704 - DNA, 13 bp, Artificial Sequence
  synthetic sequence
acgtacttggctt

SEQ ID NO: 15705 - DNA, 13 bp, Artificial Sequence
  synthetic sequence
tcttcatcgatcg

SEQ ID NO: 15706 - DNA, 13 bp, Artificial Sequence
  synthetic sequence
ctttctgggcttc

SEQ ID NO: 15707 - DNA, 13 bp, Artificial Sequence
  synthetic sequence
agccatcacaaac

SEQ ID NO: 15708 - DNA, 13 bp, Artificial Sequence
  synthetic sequence
attgtcttgccga

SEQ ID NO: 15709 - DNA, 13 bp, Artificial Sequence
  synthetic sequence
cgaacagcatcac

SEQ ID NO: 15710 - DNA, 13 bp, Artificial Sequence
  synthetic sequence
tgcaggatcgcca

SEQ ID NO: 15711 - DNA, 13 bp, Artificial Sequence
  synthetic sequence
gacggaactgctg

SEQ ID NO: 15712 - DNA, 13 bp, Artificial Sequence
  synthetic sequence
acggatatgtatt

SEQ ID NO: 15713 - DNA, 13 bp, Artificial Sequence
  synthetic sequence
aagcagcaagcgc

SEQ ID NO: 15714 - DNA, 13 bp, Artificial Sequence
  synthetic sequence
agttcgccatctg

SEQ ID NO: 15715 - DNA, 13 bp, Artificial Sequence
  synthetic sequence
aggtcgttggtcg

SEQ ID NO: 15716 - DNA, 13 bp, Artificial Sequence
  synthetic sequence
aaaacgacgataa

SEQ ID NO: 15717 - DNA, 13 bp, Artificial Sequence
  synthetic sequence
attgaacgaccaa

SEQ ID NO: 15718 - DNA, 13 bp, Artificial Sequence
  synthetic sequence
tcggcatcaccct

SEQ ID NO: 15719 - DNA, 13 bp, Artificial Sequence
  synthetic sequence
gaaccaaataata

SEQ ID NO: 15720 - DNA, 13 bp, Artificial Sequence
  synthetic sequence
tgacggcattgct

SEQ ID NO: 15721 - DNA, 13 bp, Artificial Sequence
  synthetic sequence
tatctgttcctgc

SEQ ID NO: 15722 - DNA, 13 bp, Artificial Sequence
  synthetic sequence
gtgatgttcggct

SEQ ID NO: 15723 - DNA, 13 bp, Artificial Sequence
  synthetic sequence
gcctacgacgcca

SEQ ID NO: 15724 - DNA, 13 bp, Artificial Sequence
  synthetic sequence
gtctgcgtagtat

SEQ ID NO: 15725 - DNA, 13 bp, Artificial Sequence
  synthetic sequence
atcaccagcggca

SEQ ID NO: 15726 - DNA, 13 bp, Artificial Sequence
  synthetic sequence
atggtgttgttgc

SEQ ID NO: 15727 - DNA, 13 bp, Artificial Sequence
  synthetic sequence
aacgcagcggtgg

SEQ ID NO: 15728 - DNA, 13 bp, Artificial Sequence
  synthetic sequence
gccatcctacgca

SEQ ID NO: 15729 - DNA, 13 bp, Artificial Sequence
  synthetic sequence
ttatcaaccaagt

SEQ ID NO: 15730 - DNA, 13 bp, Artificial Sequence
  synthetic sequence
acaaataacttct

SEQ ID NO: 15731 - DNA, 13 bp, Artificial Sequence
  synthetic sequence
ttgctggaactgg

SEQ ID NO: 15732 - DNA, 13 bp, Artificial Sequence
  synthetic sequence
cgtaactctccca

SEQ ID NO: 15733 - DNA, 13 bp, Artificial Sequence
  synthetic sequence
cctgatgcgcttc

SEQ ID NO: 15734 - DNA, 13 bp, Artificial Sequence
  synthetic sequence
ggatcgacagcgg

SEQ ID NO: 15735 - DNA, 13 bp, Artificial Sequence
  synthetic sequence
tcttcttcggtca

SEQ ID NO: 15736 - DNA, 13 bp, Artificial Sequence
  synthetic sequence
tgacaatattatc

SEQ ID NO: 15737 - DNA, 13 bp, Artificial Sequence
  synthetic sequence
gcctggtcaatca

SEQ ID NO: 15738 - DNA, 13 bp, Artificial Sequence
  synthetic sequence
tcaatcagttcgg

SEQ ID NO: 15739 - DNA, 13 bp, Artificial Sequence
  synthetic sequence
aagcgatcagaca

SEQ ID NO: 15740 - DNA, 13 bp, Artificial Sequence
  synthetic sequence
tgacggtcgacac

SEQ ID NO: 15741 - DNA, 13 bp, Artificial Sequence
  synthetic sequence
ccccaaataacat

SEQ ID NO: 15742 - DNA, 13 bp, Artificial Sequence
  synthetic sequence
ggacataccactt

SEQ ID NO: 15743 - DNA, 13 bp, Artificial Sequence
  synthetic sequence
gttcatgcagaac

SEQ ID NO: 15744 - DNA, 13 bp, Artificial Sequence
  synthetic sequence
gccaacgaggacg

SEQ ID NO: 15745 - DNA, 13 bp, Artificial Sequence
  synthetic sequence
aaaggcacgaatc

SEQ ID NO: 15746 - DNA, 13 bp, Artificial Sequence
  synthetic sequence
cagtacctacaac

SEQ ID NO: 15747 - DNA, 13 bp, Artificial Sequence
  synthetic sequence
tggtcggggaaac

SEQ ID NO: 15748 - DNA, 13 bp, Artificial Sequence
  synthetic sequence
ccgttgatctgga

SEQ ID NO: 15749 - DNA, 13 bp, Artificial Sequence
  synthetic sequence
gccagcgacatcg

SEQ ID NO: 15750 - DNA, 13 bp, Artificial Sequence
  synthetic sequence
ccgaccggtttcg

SEQ ID NO: 15751 - DNA, 13 bp, Artificial Sequence
  synthetic sequence
gatggcactggtc

SEQ ID NO: 15752 - DNA, 13 bp, Artificial Sequence
  synthetic sequence
cagttgctggcgc

SEQ ID NO: 15753 - DNA, 13 bp, Artificial Sequence
  synthetic sequence
cttctgaaacata

SEQ ID NO: 15754 - DNA, 13 bp, Artificial Sequence
  synthetic sequence
ctgcgaaatttcg

SEQ ID NO: 15755 - DNA, 13 bp, Artificial Sequence
  synthetic sequence
aaacgcttcgggc

SEQ ID NO: 15756 - DNA, 13 bp, Artificial Sequence
  synthetic sequence
acgtcaacgatgg

SEQ ID NO: 15757 - DNA, 13 bp, Artificial Sequence
  synthetic sequence
catcaaaggttgg

SEQ ID NO: 15758 - DNA, 13 bp, Artificial Sequence
  synthetic sequence
ttcagtttcttga

SEQ ID NO: 15759 - DNA, 13 bp, Artificial Sequence
  synthetic sequence
agagtaagtagtt

SEQ ID NO: 15760 - DNA, 13 bp, Artificial Sequence
  synthetic sequence
tcattgacgtccc

SEQ ID NO: 15761 - DNA, 13 bp, Artificial Sequence
  synthetic sequence
ttgtttgaggtga

SEQ ID NO: 15762 - DNA, 13 bp, Artificial Sequence
  synthetic sequence
gtgatatgcacat

SEQ ID NO: 15763 - DNA, 13 bp, Artificial Sequence
  synthetic sequence
acttcgttcgcca

SEQ ID NO: 15764 - DNA, 13 bp, Artificial Sequence
  synthetic sequence
agttccggcatac

SEQ ID NO: 15765 - DNA, 13 bp, Artificial Sequence
  synthetic sequence
ggcgtcaggatca

SEQ ID NO: 15766 - DNA, 13 bp, Artificial Sequence
  synthetic sequence
cgcaggtcgtcga

SEQ ID NO: 15767 - DNA, 13 bp, Artificial Sequence
  synthetic sequence
aggaagatatcgc

SEQ ID NO: 15768 - DNA, 13 bp, Artificial Sequence
  synthetic sequence
atggtaaccatca

SEQ ID NO: 15769 - DNA, 13 bp, Artificial Sequence
  synthetic sequence
acctcaaaactgg

SEQ ID NO: 15770 - DNA, 13 bp, Artificial Sequence
  synthetic sequence
tagctggcgatca

SEQ ID NO: 15771 - DNA, 13 bp, Artificial Sequence
  synthetic sequence
atatgcactcgct

SEQ ID NO: 15772 - DNA, 13 bp, Artificial Sequence
  synthetic sequence
catatatttctct

SEQ ID NO: 15773 - DNA, 13 bp, Artificial Sequence
  synthetic sequence
cttcgtagccatt

SEQ ID NO: 15774 - DNA, 13 bp, Artificial Sequence
  synthetic sequence
cagaacgaatggt

SEQ ID NO: 15775 - DNA, 13 bp, Artificial Sequence
  synthetic sequence
ttgtcacctggtt

SEQ ID NO: 15776 - DNA, 13 bp, Artificial Sequence
  synthetic sequence
aaaagcggaaaac

SEQ ID NO: 15777 - DNA, 13 bp, Artificial Sequence
  synthetic sequence
accagcagatcct

SEQ ID NO: 15778 - DNA, 13 bp, Artificial Sequence
  synthetic sequence
tctttactagata

SEQ ID NO: 15779 - DNA, 13 bp, Artificial Sequence
  synthetic sequence
gtcctcccgcaaa

SEQ ID NO: 15780 - DNA, 13 bp, Artificial Sequence
  synthetic sequence
cgggatcgaccag

SEQ ID NO: 15781 - DNA, 13 bp, Artificial Sequence
  synthetic sequence
tttatccattatc

SEQ ID NO: 15782 - DNA, 13 bp, Artificial Sequence
  synthetic sequence
agaccgtgcagga

SEQ ID NO: 15783 - DNA, 13 bp, Artificial Sequence
  synthetic sequence
agtgctcgatcag

SEQ ID NO: 15784 - DNA, 13 bp, Artificial Sequence
  synthetic sequence
gctgcctgcagtt

SEQ ID NO: 15785 - DNA, 13 bp, Artificial Sequence
  synthetic sequence
accatcgccagca

SEQ ID NO: 15786 - DNA, 13 bp, Artificial Sequence
  synthetic sequence
acctcatccagca

SEQ ID NO: 15787 - DNA, 13 bp, Artificial Sequence
  synthetic sequence
gaacaaccgcgac

SEQ ID NO: 15788 - DNA, 13 bp, Artificial Sequence
  synthetic sequence
cagcgacaccacc

SEQ ID NO: 15789 - DNA, 13 bp, Artificial Sequence
  synthetic sequence
gactgagcgattt

SEQ ID NO: 15790 - DNA, 13 bp, Artificial Sequence
  synthetic sequence
gccagcatcacga

SEQ ID NO: 15791 - DNA, 13 bp, Artificial Sequence
  synthetic sequence
tgtgcaccagaac

SEQ ID NO: 15792 - DNA, 13 bp, Artificial Sequence
  synthetic sequence
acttccttgatca

SEQ ID NO: 15793 - DNA, 13 bp, Artificial Sequence
  synthetic sequence
actggaaaagaaa

SEQ ID NO: 15794 - DNA, 13 bp, Artificial Sequence
  synthetic sequence
attttcgccgccg

SEQ ID NO: 15795 - DNA, 13 bp, Artificial Sequence
  synthetic sequence
ttcaatctggtta

SEQ ID NO: 15796 - DNA, 13 bp, Artificial Sequence
  synthetic sequence
ttcgcctttaact

SEQ ID NO: 15797 - DNA, 13 bp, Artificial Sequence
  synthetic sequence
atgaatatcctcg

SEQ ID NO: 15798 - DNA, 13 bp, Artificial Sequence
  synthetic sequence
tcgccatggacct

SEQ ID NO: 15799 - DNA, 13 bp, Artificial Sequence
  synthetic sequence
atttgcgtcactt

SEQ ID NO: 15800 - DNA, 13 bp, Artificial Sequence
  synthetic sequence
aatacatcgcgac

SEQ ID NO: 15801 - DNA, 13 bp, Artificial Sequence
  synthetic sequence
gccatcttcaccg

SEQ ID NO: 15802 - DNA, 13 bp, Artificial Sequence
  synthetic sequence
acttcatcgaccg

SEQ ID NO: 15803 - DNA, 13 bp, Artificial Sequence
  synthetic sequence
cagcttgcgcagg

SEQ ID NO: 15804 - DNA, 13 bp, Artificial Sequence
  synthetic sequence
cgcttgcggcttg

SEQ ID NO: 15805 - DNA, 13 bp, Artificial Sequence
  synthetic sequence
tctcagttaaaca

SEQ ID NO: 15806 - DNA, 13 bp, Artificial Sequence
  synthetic sequence
gcgcaggacaagg

SEQ ID NO: 15807 - DNA, 13 bp, Artificial Sequence
  synthetic sequence
gcattgcataaga

SEQ ID NO: 15808 - DNA, 13 bp, Artificial Sequence
  synthetic sequence
tgtcgatggacac

SEQ ID NO: 15809 - DNA, 13 bp, Artificial Sequence
  synthetic sequence
aagatgtggctat

SEQ ID NO: 15810 - DNA, 13 bp, Artificial Sequence
  synthetic sequence
gatcattccgctg

SEQ ID NO: 15811 - DNA, 13 bp, Artificial Sequence
  synthetic sequence
gctgctgtaaatt

SEQ ID NO: 15812 - DNA, 13 bp, Artificial Sequence
  synthetic sequence
ccccgaatatcta

SEQ ID NO: 15813 - DNA, 13 bp, Artificial Sequence
  synthetic sequence
ccttatggtcaac

SEQ ID NO: 15814 - DNA, 13 bp, Artificial Sequence
  synthetic sequence
ctgctgaaggtga

SEQ ID NO: 15815 - DNA, 13 bp, Artificial Sequence
  synthetic sequence
acgctctgcatcg

SEQ ID NO: 15816 - DNA, 13 bp, Artificial Sequence
  synthetic sequence
gttaacccatttc

SEQ ID NO: 15817 - DNA, 13 bp, Artificial Sequence
  synthetic sequence
tgttcaccgagaa

SEQ ID NO: 15818 - DNA, 13 bp, Artificial Sequence
  synthetic sequence
gcagggttcatag

SEQ ID NO: 15819 - DNA, 13 bp, Artificial Sequence
  synthetic sequence
ctttctgggtacg

SEQ ID NO: 15820 - DNA, 13 bp, Artificial Sequence
  synthetic sequence
aacgcctgaaggt

SEQ ID NO: 15821 - DNA, 13 bp, Artificial Sequence
  synthetic sequence
gaaaagagtattt

SEQ ID NO: 15822 - DNA, 13 bp, Artificial Sequence
  synthetic sequence
agcctgcagcagc

SEQ ID NO: 15823 - DNA, 13 bp, Artificial Sequence
  synthetic sequence
tgcggcgtaacaa

SEQ ID NO: 15824 - DNA, 13 bp, Artificial Sequence
  synthetic sequence
atagccgcagata

SEQ ID NO: 15825 - DNA, 13 bp, Artificial Sequence
  synthetic sequence
aggaacagcggca

SEQ ID NO: 15826 - DNA, 13 bp, Artificial Sequence
  synthetic sequence
agcaaatactctt

SEQ ID NO: 15827 - DNA, 13 bp, Artificial Sequence
  synthetic sequence
aatcatacgaata

SEQ ID NO: 15828 - DNA, 13 bp, Artificial Sequence
  synthetic sequence
atccttacttctt

SEQ ID NO: 15829 - DNA, 13 bp, Artificial Sequence
  synthetic sequence
gccagcgcatcca

SEQ ID NO: 15830 - DNA, 13 bp, Artificial Sequence
  synthetic sequence
aacccggctctcg

SEQ ID NO: 15831 - DNA, 13 bp, Artificial Sequence
  synthetic sequence
cgcaggagtggtg

SEQ ID NO: 15832 - DNA, 13 bp, Artificial Sequence
  synthetic sequence
atgcgtgctaagg

SEQ ID NO: 15833 - DNA, 13 bp, Artificial Sequence
  synthetic sequence
gcctgttcccgca

SEQ ID NO: 15834 - DNA, 13 bp, Artificial Sequence
  synthetic sequence
gatttatggggaa

SEQ ID NO: 15835 - DNA, 13 bp, Artificial Sequence
  synthetic sequence
gatcgcgtagtcg

SEQ ID NO: 15836 - DNA, 13 bp, Artificial Sequence
  synthetic sequence
ataaagaatgaac

SEQ ID NO: 15837 - DNA, 13 bp, Artificial Sequence
  synthetic sequence
aatgcggattcag

SEQ ID NO: 15838 - DNA, 13 bp, Artificial Sequence
  synthetic sequence
cgcaaaacctgcg

SEQ ID NO: 15839 - DNA, 13 bp, Artificial Sequence
  synthetic sequence
atttcgccgttgg

SEQ ID NO: 15840 - DNA, 13 bp, Artificial Sequence
  synthetic sequence
gataagccgcttg

SEQ ID NO: 15841 - DNA, 13 bp, Artificial Sequence
  synthetic sequence
aatctggtgctgg

SEQ ID NO: 15842 - DNA, 13 bp, Artificial Sequence
  synthetic sequence
ttgccatctgctc

SEQ ID NO: 15843 - DNA, 13 bp, Artificial Sequence
  synthetic sequence
ctgctgatcaccg

SEQ ID NO: 15844 - DNA, 13 bp, Artificial Sequence
  synthetic sequence
cttctgactgagc

SEQ ID NO: 15845 - DNA, 13 bp, Artificial Sequence
  synthetic sequence
cagcaataaacca

SEQ ID NO: 15846 - DNA, 13 bp, Artificial Sequence
  synthetic sequence
gtaattctgagca

SEQ ID NO: 15847 - DNA, 13 bp, Artificial Sequence
  synthetic sequence
gttgagcctggtg

SEQ ID NO: 15848 - DNA, 13 bp, Artificial Sequence
  synthetic sequence
ggcaatgccagac

SEQ ID NO: 15849 - DNA, 13 bp, Artificial Sequence
  synthetic sequence
ctaataccggtgt

SEQ ID NO: 15850 - DNA, 13 bp, Artificial Sequence
  synthetic sequence
aattcagaggctg

SEQ ID NO: 15851 - DNA, 13 bp, Artificial Sequence
  synthetic sequence
gtagctgtccagt

SEQ ID NO: 15852 - DNA, 13 bp, Artificial Sequence
  synthetic sequence
atcgttctaatag

SEQ ID NO: 15853 - DNA, 13 bp, Artificial Sequence
  synthetic sequence
gcaattcgcgatg

SEQ ID NO: 15854 - DNA, 13 bp, Artificial Sequence
  synthetic sequence
gacagcttccaac

SEQ ID NO: 15855 - DNA, 13 bp, Artificial Sequence
  synthetic sequence
agaaacgtcaatt

SEQ ID NO: 15856 - DNA, 13 bp, Artificial Sequence
  synthetic sequence
ctcataacagtag

SEQ ID NO: 15857 - DNA, 13 bp, Artificial Sequence
  synthetic sequence
tctggctgaactg

SEQ ID NO: 15858 - DNA, 13 bp, Artificial Sequence
  synthetic sequence
acaaagatgttgc

SEQ ID NO: 15859 - DNA, 13 bp, Artificial Sequence
  synthetic sequence
aataatagagtcc

SEQ ID NO: 15860 - DNA, 13 bp, Artificial Sequence
  synthetic sequence
gcaaagctttctt

SEQ ID NO: 15861 - DNA, 13 bp, Artificial Sequence
  synthetic sequence
aaacgcttttcgg

SEQ ID NO: 15862 - DNA, 13 bp, Artificial Sequence
  synthetic sequence
tggtggcgcacag

SEQ ID NO: 15863 - DNA, 13 bp, Artificial Sequence
  synthetic sequence
gtcagaatcagtg

SEQ ID NO: 15864 - DNA, 13 bp, Artificial Sequence
  synthetic sequence
tcatctgccagga

SEQ ID NO: 15865 - DNA, 13 bp, Artificial Sequence
  synthetic sequence
tgaggggttaaca

SEQ ID NO: 15866 - DNA, 13 bp, Artificial Sequence
  synthetic sequence
cctgtcaggtaac

SEQ ID NO: 15867 - DNA, 13 bp, Artificial Sequence
  synthetic sequence
gaagcgcgtcagt

SEQ ID NO: 15868 - DNA, 13 bp, Artificial Sequence
  synthetic sequence
atcaatatcggga

SEQ ID NO: 15869 - DNA, 13 bp, Artificial Sequence
  synthetic sequence
cgcttttagaacg

SEQ ID NO: 15870 - DNA, 13 bp, Artificial Sequence
  synthetic sequence
cgggtcagtatcc

SEQ ID NO: 15871 - DNA, 13 bp, Artificial Sequence
  synthetic sequence
cagcacgaacagg

SEQ ID NO: 15872 - DNA, 13 bp, Artificial Sequence
  synthetic sequence
atatacgattctg

SEQ ID NO: 15873 - DNA, 13 bp, Artificial Sequence
  synthetic sequence
ttgattgccgcca

SEQ ID NO: 15874 - DNA, 13 bp, Artificial Sequence
  synthetic sequence
tgccgccctaact

SEQ ID NO: 15875 - DNA, 13 bp, Artificial Sequence
  synthetic sequence
gctatggcaatat

SEQ ID NO: 15876 - DNA, 13 bp, Artificial Sequence
  synthetic sequence
agctgcgccttcg

SEQ ID NO: 15877 - DNA, 13 bp, Artificial Sequence
  synthetic sequence
cacggactgctgc

SEQ ID NO: 15878 - DNA, 13 bp, Artificial Sequence
  synthetic sequence
gctgcatcttcta

SEQ ID NO: 15879 - DNA, 13 bp, Artificial Sequence
  synthetic sequence
ttggagcggcagc

SEQ ID NO: 15880 - DNA, 13 bp, Artificial Sequence
  synthetic sequence
ctcgggatatctt

SEQ ID NO: 15881 - DNA, 13 bp, Artificial Sequence
  synthetic sequence
ctggtcgggtact

SEQ ID NO: 15882 - DNA, 13 bp, Artificial Sequence
  synthetic sequence
tgccgcaactttc

SEQ ID NO: 15883 - DNA, 13 bp, Artificial Sequence
  synthetic sequence
catttggatagct

SEQ ID NO: 15884 - DNA, 13 bp, Artificial Sequence
  synthetic sequence
tccagcagcagca

SEQ ID NO: 15885 - DNA, 13 bp, Artificial Sequence
  synthetic sequence
tcattgggtcgaa

SEQ ID NO: 15886 - DNA, 13 bp, Artificial Sequence
  synthetic sequence
atgtaacagaaaa

SEQ ID NO: 15887 - DNA, 13 bp, Artificial Sequence
  synthetic sequence
atattttcttctc

SEQ ID NO: 15888 - DNA, 13 bp, Artificial Sequence
  synthetic sequence
attaaagagaaac

SEQ ID NO: 15889 - DNA, 13 bp, Artificial Sequence
  synthetic sequence
cgaaattgaatca

SEQ ID NO: 15890 - DNA, 13 bp, Artificial Sequence
  synthetic sequence
acgaatgtctcct

SEQ ID NO: 15891 - DNA, 13 bp, Artificial Sequence
  synthetic sequence
ttgtgcaggcttt

SEQ ID NO: 15892 - DNA, 13 bp, Artificial Sequence
  synthetic sequence
tcccacatcagat

SEQ ID NO: 15893 - DNA, 13 bp, Artificial Sequence
  synthetic sequence
tatctatccgact

SEQ ID NO: 15894 - DNA, 13 bp, Artificial Sequence
  synthetic sequence
aacaacaataccc

SEQ ID NO: 15895 - DNA, 13 bp, Artificial Sequence
  synthetic sequence
gcccaggacaaga

SEQ ID NO: 15896 - DNA, 13 bp, Artificial Sequence
  synthetic sequence
tcgcaattggaga

SEQ ID NO: 15897 - DNA, 13 bp, Artificial Sequence
  synthetic sequence
agctttaccatta

SEQ ID NO: 15898 - DNA, 13 bp, Artificial Sequence
  synthetic sequence
aggaatggctgta

SEQ ID NO: 15899 - DNA, 13 bp, Artificial Sequence
  synthetic sequence
gccctgggtcatg

SEQ ID NO: 15900 - DNA, 13 bp, Artificial Sequence
  synthetic sequence
gaaggtctctcgc

SEQ ID NO: 15901 - DNA, 13 bp, Artificial Sequence
  synthetic sequence
gaccttgttcggg

SEQ ID NO: 15902 - DNA, 13 bp, Artificial Sequence
  synthetic sequence
aggtctttatcgt

SEQ ID NO: 15903 - DNA, 13 bp, Artificial Sequence
  synthetic sequence
cttaccgttatca

SEQ ID NO: 15904 - DNA, 13 bp, Artificial Sequence
  synthetic sequence
cattttggtaaag

SEQ ID NO: 15905 - DNA, 13 bp, Artificial Sequence
  synthetic sequence
aggtatcggggta

SEQ ID NO: 15906 - DNA, 13 bp, Artificial Sequence
  synthetic sequence
tgattgtttcatt

SEQ ID NO: 15907 - DNA, 13 bp, Artificial Sequence
  synthetic sequence
tggtcaccagcgt

SEQ ID NO: 15908 - DNA, 13 bp, Artificial Sequence
  synthetic sequence
gcatctccgcagg

SEQ ID NO: 15909 - DNA, 13 bp, Artificial Sequence
  synthetic sequence
acacccagtaggc

SEQ ID NO: 15910 - DNA, 13 bp, Artificial Sequence
  synthetic sequence
cttaggcattctg

SEQ ID NO: 15911 - DNA, 13 bp, Artificial Sequence
  synthetic sequence
ggcacattattat

SEQ ID NO: 15912 - DNA, 13 bp, Artificial Sequence
  synthetic sequence
ttttgatatgagt

SEQ ID NO: 15913 - DNA, 13 bp, Artificial Sequence
  synthetic sequence
ctgataactgtcc

SEQ ID NO: 15914 - DNA, 13 bp, Artificial Sequence
  synthetic sequence
ggtctccattggc

SEQ ID NO: 15915 - DNA, 13 bp, Artificial Sequence
  synthetic sequence
ccaacgcgccaca

SEQ ID NO: 15916 - DNA, 13 bp, Artificial Sequence
  synthetic sequence
ttgtactttccct

SEQ ID NO: 15917 - DNA, 13 bp, Artificial Sequence
  synthetic sequence
cttctttagtatc

SEQ ID NO: 15918 - DNA, 13 bp, Artificial Sequence
  synthetic sequence
atccaaataatcc

SEQ ID NO: 15919 - DNA, 13 bp, Artificial Sequence
  synthetic sequence
gggaacagccgta

SEQ ID NO: 15920 - DNA, 13 bp, Artificial Sequence
  synthetic sequence
tcggtcagcaaaa

SEQ ID NO: 15921 - DNA, 13 bp, Artificial Sequence
  synthetic sequence
tgcagctcggcga

SEQ ID NO: 15922 - DNA, 13 bp, Artificial Sequence
  synthetic sequence
cgcaaatcaaaga

SEQ ID NO: 15923 - DNA, 13 bp, Artificial Sequence
  synthetic sequence
tctggttgatgaa

SEQ ID NO: 15924 - DNA, 13 bp, Artificial Sequence
  synthetic sequence
ggtgtggactctg

SEQ ID NO: 15925 - DNA, 13 bp, Artificial Sequence
  synthetic sequence
ccgcaggctgttc

SEQ ID NO: 15926 - DNA, 13 bp, Artificial Sequence
  synthetic sequence
aacccgtcctgat

SEQ ID NO: 15927 - DNA, 13 bp, Artificial Sequence
  synthetic sequence
cccaatcaggctt

SEQ ID NO: 15928 - DNA, 13 bp, Artificial Sequence
  synthetic sequence
agaaaccgcttca

SEQ ID NO: 15929 - DNA, 13 bp, Artificial Sequence
  synthetic sequence
acgctactgatgg

SEQ ID NO: 15930 - DNA, 13 bp, Artificial Sequence
  synthetic sequence
atgtcattgcgct

SEQ ID NO: 15931 - DNA, 13 bp, Artificial Sequence
  synthetic sequence
tcgacgaactccc

SEQ ID NO: 15932 - DNA, 13 bp, Artificial Sequence
  synthetic sequence
ccagcaactggtc

SEQ ID NO: 15933 - DNA, 13 bp, Artificial Sequence
  synthetic sequence
gttgagaatctgc

SEQ ID NO: 15934 - DNA, 13 bp, Artificial Sequence
  synthetic sequence
cgtttacaaaacg

SEQ ID NO: 15935 - DNA, 13 bp, Artificial Sequence
  synthetic sequence
tcatgtgatttcg

SEQ ID NO: 15936 - DNA, 13 bp, Artificial Sequence
  synthetic sequence
ctgtcggtggcga

SEQ ID NO: 15937 - DNA, 13 bp, Artificial Sequence
  synthetic sequence
aacaccatgccaa

SEQ ID NO: 15938 - DNA, 13 bp, Artificial Sequence
  synthetic sequence
ctatcagcttatc

SEQ ID NO: 15939 - DNA, 13 bp, Artificial Sequence
  synthetic sequence
ctttgcggaaatg

SEQ ID NO: 15940 - DNA, 13 bp, Artificial Sequence
  synthetic sequence
ttcgccctgacca

SEQ ID NO: 15941 - DNA, 13 bp, Artificial Sequence
  synthetic sequence
cttgtttcatttt

SEQ ID NO: 15942 - DNA, 13 bp, Artificial Sequence
  synthetic sequence
taaaggcaatcac

SEQ ID NO: 15943 - DNA, 13 bp, Artificial Sequence
  synthetic sequence
cgtgcggatgttt

SEQ ID NO: 15944 - DNA, 13 bp, Artificial Sequence
  synthetic sequence
cagttgaataatg

SEQ ID NO: 15945 - DNA, 13 bp, Artificial Sequence
  synthetic sequence
cttttgatagaga

SEQ ID NO: 15946 - DNA, 13 bp, Artificial Sequence
  synthetic sequence
tattagacgagca

SEQ ID NO: 15947 - DNA, 13 bp, Artificial Sequence
  synthetic sequence
gaacacgaccgtg

SEQ ID NO: 15948 - DNA, 13 bp, Artificial Sequence
  synthetic sequence
cagtcgccctaaa

SEQ ID NO: 15949 - DNA, 13 bp, Artificial Sequence
  synthetic sequence
gattttcgtaatg

SEQ ID NO: 15950 - DNA, 13 bp, Artificial Sequence
  synthetic sequence
tcgagttctgctt

SEQ ID NO: 15951 - DNA, 13 bp, Artificial Sequence
  synthetic sequence
tgctcctgttgcc

SEQ ID NO: 15952 - DNA, 13 bp, Artificial Sequence
  synthetic sequence
actaagaacagcg

SEQ ID NO: 15953 - DNA, 13 bp, Artificial Sequence
  synthetic sequence
aaaagcccgttcc

SEQ ID NO: 15954 - DNA, 13 bp, Artificial Sequence
  synthetic sequence
aatgtatagacaa

SEQ ID NO: 15955 - DNA, 13 bp, Artificial Sequence
  synthetic sequence
atgccgacgccga

SEQ ID NO: 15956 - DNA, 13 bp, Artificial Sequence
  synthetic sequence
ttcttcataatca

SEQ ID NO: 15957 - DNA, 13 bp, Artificial Sequence
  synthetic sequence
aacgcgtacgttt

SEQ ID NO: 15958 - DNA, 13 bp, Artificial Sequence
  synthetic sequence
gtggtgccctgct

SEQ ID NO: 15959 - DNA, 13 bp, Artificial Sequence
  synthetic sequence
gcctgatcgccga

SEQ ID NO: 15960 - DNA, 13 bp, Artificial Sequence
  synthetic sequence
gccagtttgatac

SEQ ID NO: 15961 - DNA, 13 bp, Artificial Sequence
  synthetic sequence
atgattcctccaa

SEQ ID NO: 15962 - DNA, 13 bp, Artificial Sequence
  synthetic sequence
ctttcatacctaa

SEQ ID NO: 15963 - DNA, 13 bp, Artificial Sequence
  synthetic sequence
tttattaccgttc

SEQ ID NO: 15964 - DNA, 13 bp, Artificial Sequence
  synthetic sequence
caatctcgattac

SEQ ID NO: 15965 - DNA, 13 bp, Artificial Sequence
  synthetic sequence
ggagcagatggtt

SEQ ID NO: 15966 - DNA, 13 bp, Artificial Sequence
  synthetic sequence
aatattctcggct

SEQ ID NO: 15967 - DNA, 13 bp, Artificial Sequence
  synthetic sequence
gtttgctccggta

SEQ ID NO: 15968 - DNA, 13 bp, Artificial Sequence
  synthetic sequence
atatgtcgaaatg

SEQ ID NO: 15969 - DNA, 13 bp, Artificial Sequence
  synthetic sequence
gagcttacattta

SEQ ID NO: 15970 - DNA, 13 bp, Artificial Sequence
  synthetic sequence
tggtgggtatcgc

SEQ ID NO: 15971 - DNA, 13 bp, Artificial Sequence
  synthetic sequence
gtgatcgcgttcg

SEQ ID NO: 15972 - DNA, 13 bp, Artificial Sequence
  synthetic sequence
ggggtgtgatgat

SEQ ID NO: 15973 - DNA, 13 bp, Artificial Sequence
  synthetic sequence
cctgatgtatcga

SEQ ID NO: 15974 - DNA, 13 bp, Artificial Sequence
  synthetic sequence
caagggcagtgcg

SEQ ID NO: 15975 - DNA, 13 bp, Artificial Sequence
  synthetic sequence
tatcgggtggatt

SEQ ID NO: 15976 - DNA, 13 bp, Artificial Sequence
  synthetic sequence
ttgatccccagac

SEQ ID NO: 15977 - DNA, 13 bp, Artificial Sequence
  synthetic sequence
tcggccaggtgca

SEQ ID NO: 15978 - DNA, 13 bp, Artificial Sequence
  synthetic sequence
gtgaagccgtctg

SEQ ID NO: 15979 - DNA, 13 bp, Artificial Sequence
  synthetic sequence
aggtgacgccgaa

SEQ ID NO: 15980 - DNA, 13 bp, Artificial Sequence
  synthetic sequence
atttcaaccgtga

SEQ ID NO: 15981 - DNA, 13 bp, Artificial Sequence
  synthetic sequence
agcgtcaaagggg

SEQ ID NO: 15982 - DNA, 13 bp, Artificial Sequence
  synthetic sequence
aatgccaatgcgc

SEQ ID NO: 15983 - DNA, 13 bp, Artificial Sequence
  synthetic sequence
cacgcaagacctc

SEQ ID NO: 15984 - DNA, 13 bp, Artificial Sequence
  synthetic sequence
catagacggagtg

SEQ ID NO: 15985 - DNA, 13 bp, Artificial Sequence
  synthetic sequence
cggtcacttcatt

SEQ ID NO: 15986 - DNA, 13 bp, Artificial Sequence
  synthetic sequence
tctactggaatta

SEQ ID NO: 15987 - DNA, 13 bp, Artificial Sequence
  synthetic sequence
acgaggaaggcca

SEQ ID NO: 15988 - DNA, 13 bp, Artificial Sequence
  synthetic sequence
aggatcttttcgg

SEQ ID NO: 15989 - DNA, 13 bp, Artificial Sequence
  synthetic sequence
acgcgcatcgagt

SEQ ID NO: 15990 - DNA, 13 bp, Artificial Sequence
  synthetic sequence
aatcgctgggctt

SEQ ID NO: 15991 - DNA, 13 bp, Artificial Sequence
  synthetic sequence
aggacgcctacat

SEQ ID NO: 15992 - DNA, 13 bp, Artificial Sequence
  synthetic sequence
cggtggttcgctg

SEQ ID NO: 15993 - DNA, 13 bp, Artificial Sequence
  synthetic sequence
cgtaaaaccggct

SEQ ID NO: 15994 - DNA, 13 bp, Artificial Sequence
  synthetic sequence
cagcgtgagcgag

SEQ ID NO: 15995 - DNA, 13 bp, Artificial Sequence
  synthetic sequence
ggaaacgaaacct

SEQ ID NO: 15996 - DNA, 13 bp, Artificial Sequence
  synthetic sequence
ccgtgatcttcca

SEQ ID NO: 15997 - DNA, 13 bp, Artificial Sequence
  synthetic sequence
ctgtctgttacac

SEQ ID NO: 15998 - DNA, 13 bp, Artificial Sequence
  synthetic sequence
acagcccagagct

SEQ ID NO: 15999 - DNA, 13 bp, Artificial Sequence
  synthetic sequence
acatatcccaagg

SEQ ID NO: 16000 - DNA, 13 bp, Artificial Sequence
  synthetic sequence
cggattcacttca

SEQ ID NO: 16001 - DNA, 13 bp, Artificial Sequence
  synthetic sequence
atccgggcgcaga

SEQ ID NO: 16002 - DNA, 13 bp, Artificial Sequence
  synthetic sequence
agccgccttgacc

SEQ ID NO: 16003 - DNA, 13 bp, Artificial Sequence
  synthetic sequence
ctgcaccaacaac

SEQ ID NO: 16004 - DNA, 13 bp, Artificial Sequence
  synthetic sequence
tttccgcaggtag

SEQ ID NO: 16005 - DNA, 13 bp, Artificial Sequence
  synthetic sequence
ctgatcgtcctgc

SEQ ID NO: 16006 - DNA, 13 bp, Artificial Sequence
  synthetic sequence
ttcctaatgccaa

SEQ ID NO: 16007 - DNA, 13 bp, Artificial Sequence
  synthetic sequence
ccacaaagcgata

SEQ ID NO: 16008 - DNA, 13 bp, Artificial Sequence
  synthetic sequence
agggcgagatcaa

SEQ ID NO: 16009 - DNA, 13 bp, Artificial Sequence
  synthetic sequence
tgtaataatgtcg

SEQ ID NO: 16010 - DNA, 13 bp, Artificial Sequence
  synthetic sequence
gtcaacaatggta

SEQ ID NO: 16011 - DNA, 13 bp, Artificial Sequence
  synthetic sequence
cttcacgaagtag

SEQ ID NO: 16012 - DNA, 13 bp, Artificial Sequence
  synthetic sequence
aaacttcggcttc

SEQ ID NO: 16013 - DNA, 13 bp, Artificial Sequence
  synthetic sequence
ggctgccagtttt

SEQ ID NO: 16014 - DNA, 13 bp, Artificial Sequence
  synthetic sequence
tatgttatcacac

SEQ ID NO: 16015 - DNA, 13 bp, Artificial Sequence
  synthetic sequence
tggaggacgatgt

SEQ ID NO: 16016 - DNA, 13 bp, Artificial Sequence
  synthetic sequence
tcgaggacatgct

SEQ ID NO: 16017 - DNA, 13 bp, Artificial Sequence
  synthetic sequence
aaaagttcaattg

SEQ ID NO: 16018 - DNA, 13 bp, Artificial Sequence
  synthetic sequence
ggttgtctgcttt

SEQ ID NO: 16019 - DNA, 13 bp, Artificial Sequence
  synthetic sequence
caatttgccagca

SEQ ID NO: 16020 - DNA, 13 bp, Artificial Sequence
  synthetic sequence
cctatgtcctgac

SEQ ID NO: 16021 - DNA, 13 bp, Artificial Sequence
  synthetic sequence
ttcccttagatca

SEQ ID NO: 16022 - DNA, 13 bp, Artificial Sequence
  synthetic sequence
ttttcccggagtt

SEQ ID NO: 16023 - DNA, 13 bp, Artificial Sequence
  synthetic sequence
cgcgcacgaacat

SEQ ID NO: 16024 - DNA, 13 bp, Artificial Sequence
  synthetic sequence
gggcaaacggctg

SEQ ID NO: 16025 - DNA, 13 bp, Artificial Sequence
  synthetic sequence
aagcatcgagtct

SEQ ID NO: 16026 - DNA, 13 bp, Artificial Sequence
  synthetic sequence
tacttattgtgga

SEQ ID NO: 16027 - DNA, 13 bp, Artificial Sequence
  synthetic sequence
tatagccgacccc

SEQ ID NO: 16028 - DNA, 13 bp, Artificial Sequence
  synthetic sequence
gatcgaatagccg

SEQ ID NO: 16029 - DNA, 13 bp, Artificial Sequence
  synthetic sequence
gtaactattgaaa

SEQ ID NO: 16030 - DNA, 13 bp, Artificial Sequence
  synthetic sequence
cgacgcgaatggt

SEQ ID NO: 16031 - DNA, 13 bp, Artificial Sequence
  synthetic sequence
agcgagaagccga

SEQ ID NO: 16032 - DNA, 13 bp, Artificial Sequence
  synthetic sequence
tgtcgaaggccag

SEQ ID NO: 16033 - DNA, 13 bp, Artificial Sequence
  synthetic sequence
tgtcgttctgtcc

SEQ ID NO: 16034 - DNA, 13 bp, Artificial Sequence
  synthetic sequence
gttcgggataagc

SEQ ID NO: 16035 - DNA, 13 bp, Artificial Sequence
  synthetic sequence
tcattgggcaaac

SEQ ID NO: 16036 - DNA, 13 bp, Artificial Sequence
  synthetic sequence
caactgttgaacc

SEQ ID NO: 16037 - DNA, 13 bp, Artificial Sequence
  synthetic sequence
tcaattcaaattg

SEQ ID NO: 16038 - DNA, 13 bp, Artificial Sequence
  synthetic sequence
actaagttggcat

SEQ ID NO: 16039 - DNA, 13 bp, Artificial Sequence
  synthetic sequence
ggttacgcgcttc

SEQ ID NO: 16040 - DNA, 13 bp, Artificial Sequence
  synthetic sequence
cacgcgtttcagt

SEQ ID NO: 16041 - DNA, 13 bp, Artificial Sequence
  synthetic sequence
gtctgccaagctc

SEQ ID NO: 16042 - DNA, 13 bp, Artificial Sequence
  synthetic sequence
aatgtatgtgcga

SEQ ID NO: 16043 - DNA, 13 bp, Artificial Sequence
  synthetic sequence
ttatcatcgataa

SEQ ID NO: 16044 - DNA, 13 bp, Artificial Sequence
  synthetic sequence
ctcagcctgtttg

SEQ ID NO: 16045 - DNA, 13 bp, Artificial Sequence
  synthetic sequence
cagcggcattgca

SEQ ID NO: 16046 - DNA, 13 bp, Artificial Sequence
  synthetic sequence
aggatgtccgggc

SEQ ID NO: 16047 - DNA, 13 bp, Artificial Sequence
  synthetic sequence
gtatggtgatggg

SEQ ID NO: 16048 - DNA, 13 bp, Artificial Sequence
  synthetic sequence
ggagttcagctcc

SEQ ID NO: 16049 - DNA, 13 bp, Artificial Sequence
  synthetic sequence
tcagtacggtatg

SEQ ID NO: 16050 - DNA, 13 bp, Artificial Sequence
  synthetic sequence
gttgccagtttaa

SEQ ID NO: 16051 - DNA, 13 bp, Artificial Sequence
  synthetic sequence
ccagctttcgtac

SEQ ID NO: 16052 - DNA, 13 bp, Artificial Sequence
  synthetic sequence
ctcgatccactcg

SEQ ID NO: 16053 - DNA, 13 bp, Artificial Sequence
  synthetic sequence
ccctcctggatat

SEQ ID NO: 16054 - DNA, 13 bp, Artificial Sequence
  synthetic sequence
tccgtcgcaaggc

SEQ ID NO: 16055 - DNA, 13 bp, Artificial Sequence
  synthetic sequence
tactttcaccagc

SEQ ID NO: 16056 - DNA, 13 bp, Artificial Sequence
  synthetic sequence
cgtacgccgctac

SEQ ID NO: 16057 - DNA, 13 bp, Artificial Sequence
  synthetic sequence
ggtaacgaaacca

SEQ ID NO: 16058 - DNA, 13 bp, Artificial Sequence
  synthetic sequence
ccattcatttaca

SEQ ID NO: 16059 - DNA, 13 bp, Artificial Sequence
  synthetic sequence
ctgaaccttcaaa

SEQ ID NO: 16060 - DNA, 13 bp, Artificial Sequence
  synthetic sequence
tcttggctaaata

SEQ ID NO: 16061 - DNA, 13 bp, Artificial Sequence
  synthetic sequence
atgactgccaata

SEQ ID NO: 16062 - DNA, 13 bp, Artificial Sequence
  synthetic sequence
tcatcgcccgctt

SEQ ID NO: 16063 - DNA, 13 bp, Artificial Sequence
  synthetic sequence
ttcggggacgctg

SEQ ID NO: 16064 - DNA, 13 bp, Artificial Sequence
  synthetic sequence
tgccgcaggtcga

SEQ ID NO: 16065 - DNA, 13 bp, Artificial Sequence
  synthetic sequence
catggtcgtaatt

SEQ ID NO: 16066 - DNA, 13 bp, Artificial Sequence
  synthetic sequence
tgctgttcctgcg

SEQ ID NO: 16067 - DNA, 13 bp, Artificial Sequence
  synthetic sequence
cccgccgtaatgt

SEQ ID NO: 16068 - DNA, 13 bp, Artificial Sequence
  synthetic sequence
tcatacatttctt

SEQ ID NO: 16069 - DNA, 13 bp, Artificial Sequence
  synthetic sequence
atgaggggaaaac

SEQ ID NO: 16070 - DNA, 13 bp, Artificial Sequence
  synthetic sequence
ggtgcgatccaca

SEQ ID NO: 16071 - DNA, 13 bp, Artificial Sequence
  synthetic sequence
cgggctgatactg

SEQ ID NO: 16072 - DNA, 13 bp, Artificial Sequence
  synthetic sequence
acgcacggcagga

SEQ ID NO: 16073 - DNA, 13 bp, Artificial Sequence
  synthetic sequence
gttgaagatggct

SEQ ID NO: 16074 - DNA, 13 bp, Artificial Sequence
  synthetic sequence
ccggccgatcttt

SEQ ID NO: 16075 - DNA, 13 bp, Artificial Sequence
  synthetic sequence
accattttcgata

SEQ ID NO: 16076 - DNA, 13 bp, Artificial Sequence
  synthetic sequence
gagcaggatgagg

SEQ ID NO: 16077 - DNA, 13 bp, Artificial Sequence
  synthetic sequence
aagcccttcaatg

SEQ ID NO: 16078 - DNA, 13 bp, Artificial Sequence
  synthetic sequence
tattattgctgtc

SEQ ID NO: 16079 - DNA, 13 bp, Artificial Sequence
  synthetic sequence
ctgcggatcgcga

SEQ ID NO: 16080 - DNA, 13 bp, Artificial Sequence
  synthetic sequence
gaattgcccagct

SEQ ID NO: 16081 - DNA, 13 bp, Artificial Sequence
  synthetic sequence
tcgttcgaggagc

SEQ ID NO: 16082 - DNA, 13 bp, Artificial Sequence
  synthetic sequence
gcattccttatgt

SEQ ID NO: 16083 - DNA, 13 bp, Artificial Sequence
  synthetic sequence
ttgaaataacagc

SEQ ID NO: 16084 - DNA, 13 bp, Artificial Sequence
  synthetic sequence
actaacggcatta

SEQ ID NO: 16085 - DNA, 13 bp, Artificial Sequence
  synthetic sequence
ttgatgatcaggg

SEQ ID NO: 16086 - DNA, 13 bp, Artificial Sequence
  synthetic sequence
caaagttgaagcg

SEQ ID NO: 16087 - DNA, 13 bp, Artificial Sequence
  synthetic sequence
catgccggacggt

SEQ ID NO: 16088 - DNA, 13 bp, Artificial Sequence
  synthetic sequence
caccagcttctgc

SEQ ID NO: 16089 - DNA, 13 bp, Artificial Sequence
  synthetic sequence
agggcaccagtat

SEQ ID NO: 16090 - DNA, 13 bp, Artificial Sequence
  synthetic sequence
tccttctgcgcga

SEQ ID NO: 16091 - DNA, 13 bp, Artificial Sequence
  synthetic sequence
ctcctttcaaagt

SEQ ID NO: 16092 - DNA, 13 bp, Artificial Sequence
  synthetic sequence
ggtaagccgcttc

SEQ ID NO: 16093 - DNA, 13 bp, Artificial Sequence
  synthetic sequence
gcggataacgggg

SEQ ID NO: 16094 - DNA, 13 bp, Artificial Sequence
  synthetic sequence
tattagccggtat

SEQ ID NO: 16095 - DNA, 13 bp, Artificial Sequence
  synthetic sequence
tccatcgcctggg

SEQ ID NO: 16096 - DNA, 13 bp, Artificial Sequence
  synthetic sequence
gtctgatatcaac

SEQ ID NO: 16097 - DNA, 13 bp, Artificial Sequence
  synthetic sequence
atcatcggtatca

SEQ ID NO: 16098 - DNA, 13 bp, Artificial Sequence
  synthetic sequence
aaagatcccatca

SEQ ID NO: 16099 - DNA, 13 bp, Artificial Sequence
  synthetic sequence
gttttagaaccgc

SEQ ID NO: 16100 - DNA, 13 bp, Artificial Sequence
  synthetic sequence
ggatggctgtgtt

SEQ ID NO: 16101 - DNA, 13 bp, Artificial Sequence
  synthetic sequence
taacaattcattg

SEQ ID NO: 16102 - DNA, 13 bp, Artificial Sequence
  synthetic sequence
ggtaacggcgcca

SEQ ID NO: 16103 - DNA, 13 bp, Artificial Sequence
  synthetic sequence
aatcggtttcagc

SEQ ID NO: 16104 - DNA, 13 bp, Artificial Sequence
  synthetic sequence
atcaaggatgagc

SEQ ID NO: 16105 - DNA, 13 bp, Artificial Sequence
  synthetic sequence
caccatctggccg

SEQ ID NO: 16106 - DNA, 13 bp, Artificial Sequence
  synthetic sequence
agcggctaaaatt

SEQ ID NO: 16107 - DNA, 13 bp, Artificial Sequence
  synthetic sequence
cgccagagcgaca

SEQ ID NO: 16108 - DNA, 13 bp, Artificial Sequence
  synthetic sequence
agaacttccgcgc

SEQ ID NO: 16109 - DNA, 13 bp, Artificial Sequence
  synthetic sequence
cgtcgacgatcac

SEQ ID NO: 16110 - DNA, 13 bp, Artificial Sequence
  synthetic sequence
gaaaacgcatccg

SEQ ID NO: 16111 - DNA, 13 bp, Artificial Sequence
  synthetic sequence
caacatcttcatt

SEQ ID NO: 16112 - DNA, 13 bp, Artificial Sequence
  synthetic sequence
accgggtcgatcc

SEQ ID NO: 16113 - DNA, 13 bp, Artificial Sequence
  synthetic sequence
tgtcggcggtatt

SEQ ID NO: 16114 - DNA, 13 bp, Artificial Sequence
  synthetic sequence
gttatcactcatg

SEQ ID NO: 16115 - DNA, 13 bp, Artificial Sequence
  synthetic sequence
taagtggaacgaa

SEQ ID NO: 16116 - DNA, 13 bp, Artificial Sequence
  synthetic sequence
cgatccccaacag

SEQ ID NO: 16117 - DNA, 13 bp, Artificial Sequence
  synthetic sequence
aagacccaataca

SEQ ID NO: 16118 - DNA, 13 bp, Artificial Sequence
  synthetic sequence
ataacagcactta

SEQ ID NO: 16119 - DNA, 13 bp, Artificial Sequence
  synthetic sequence
ctgctgaaagtga

SEQ ID NO: 16120 - DNA, 13 bp, Artificial Sequence
  synthetic sequence
gctgagaaaatat

SEQ ID NO: 16121 - DNA, 13 bp, Artificial Sequence
  synthetic sequence
tgctgtcgtcata

SEQ ID NO: 16122 - DNA, 13 bp, Artificial Sequence
  synthetic sequence
gggccggtgatca

SEQ ID NO: 16123 - DNA, 13 bp, Artificial Sequence
  synthetic sequence
gtctcctcgacgg

SEQ ID NO: 16124 - DNA, 13 bp, Artificial Sequence
  synthetic sequence
aaacgctgtcggt

SEQ ID NO: 16125 - DNA, 13 bp, Artificial Sequence
  synthetic sequence
tggaacttattaa

SEQ ID NO: 16126 - DNA, 13 bp, Artificial Sequence
  synthetic sequence
tgtcctaccagga

SEQ ID NO: 16127 - DNA, 13 bp, Artificial Sequence
  synthetic sequence
ctggttgcgcacg

SEQ ID NO: 16128 - DNA, 13 bp, Artificial Sequence
  synthetic sequence
ttttgttattcca

SEQ ID NO: 16129 - DNA, 13 bp, Artificial Sequence
  synthetic sequence
gcctgctcaaagc

SEQ ID NO: 16130 - DNA, 13 bp, Artificial Sequence
  synthetic sequence
acgcaggaggata

SEQ ID NO: 16131 - DNA, 13 bp, Artificial Sequence
  synthetic sequence
gacggaacggatt

SEQ ID NO: 16132 - DNA, 13 bp, Artificial Sequence
  synthetic sequence
tcagcggccgcat

SEQ ID NO: 16133 - DNA, 13 bp, Artificial Sequence
  synthetic sequence
accaccacaatcg

SEQ ID NO: 16134 - DNA, 13 bp, Artificial Sequence
  synthetic sequence
gataacgcggtag

SEQ ID NO: 16135 - DNA, 13 bp, Artificial Sequence
  synthetic sequence
gtcagcaagacct

SEQ ID NO: 16136 - DNA, 13 bp, Artificial Sequence
  synthetic sequence
tgaaagtgtcgat

SEQ ID NO: 16137 - DNA, 13 bp, Artificial Sequence
  synthetic sequence
aggagaactcaga

SEQ ID NO: 16138 - DNA, 13 bp, Artificial Sequence
  synthetic sequence
acgaccacaaaga

SEQ ID NO: 16139 - DNA, 13 bp, Artificial Sequence
  synthetic sequence
gcaccagacgcac

SEQ ID NO: 16140 - DNA, 13 bp, Artificial Sequence
  synthetic sequence
caccggcacatgg

SEQ ID NO: 16141 - DNA, 13 bp, Artificial Sequence
  synthetic sequence
aaaatcctgttga

SEQ ID NO: 16142 - DNA, 13 bp, Artificial Sequence
  synthetic sequence
cgagctgatcgag

SEQ ID NO: 16143 - DNA, 13 bp, Artificial Sequence
  synthetic sequence
tcgaggttgaccc

SEQ ID NO: 16144 - DNA, 13 bp, Artificial Sequence
  synthetic sequence
cggcagcacaaac

SEQ ID NO: 16145 - DNA, 13 bp, Artificial Sequence
  synthetic sequence
agtttatggaaaa

SEQ ID NO: 16146 - DNA, 13 bp, Artificial Sequence
  synthetic sequence
tgtaccaaatgcg

SEQ ID NO: 16147 - DNA, 13 bp, Artificial Sequence
  synthetic sequence
tgcgaattcaccg

SEQ ID NO: 16148 - DNA, 13 bp, Artificial Sequence
  synthetic sequence
cgaacatccccgg

SEQ ID NO: 16149 - DNA, 13 bp, Artificial Sequence
  synthetic sequence
gatccgatctacg

SEQ ID NO: 16150 - DNA, 13 bp, Artificial Sequence
  synthetic sequence
acggtatcgtact

SEQ ID NO: 16151 - DNA, 13 bp, Artificial Sequence
  synthetic sequence
caatcaagcggtc

SEQ ID NO: 16152 - DNA, 13 bp, Artificial Sequence
  synthetic sequence
gcaccgagcggaa

SEQ ID NO: 16153 - DNA, 13 bp, Artificial Sequence
  synthetic sequence
gacccgatctacg

SEQ ID NO: 16154 - DNA, 13 bp, Artificial Sequence
  synthetic sequence
gcaggaaggtttt

SEQ ID NO: 16155 - DNA, 13 bp, Artificial Sequence
  synthetic sequence
tgccacctgaaac

SEQ ID NO: 16156 - DNA, 13 bp, Artificial Sequence
  synthetic sequence
aacatcaaggacc

SEQ ID NO: 16157 - DNA, 13 bp, Artificial Sequence
  synthetic sequence
ttgggtttgggca

SEQ ID NO: 16158 - DNA, 13 bp, Artificial Sequence
  synthetic sequence
tcatcgaccggcc

SEQ ID NO: 16159 - DNA, 13 bp, Artificial Sequence
  synthetic sequence
catgtatcatggt

SEQ ID NO: 16160 - DNA, 13 bp, Artificial Sequence
  synthetic sequence
accgcttcggcat

SEQ ID NO: 16161 - DNA, 13 bp, Artificial Sequence
  synthetic sequence
actatttgcaaca

SEQ ID NO: 16162 - DNA, 13 bp, Artificial Sequence
  synthetic sequence
ctttgcgcggcaa

SEQ ID NO: 16163 - DNA, 13 bp, Artificial Sequence
  synthetic sequence
taggtacttgaat

SEQ ID NO: 16164 - DNA, 13 bp, Artificial Sequence
  synthetic sequence
gcaggatgtagcc

SEQ ID NO: 16165 - DNA, 13 bp, Artificial Sequence
  synthetic sequence
cattcctgccaga

SEQ ID NO: 16166 - DNA, 13 bp, Artificial Sequence
  synthetic sequence
atgctcaatatct

SEQ ID NO: 16167 - DNA, 13 bp, Artificial Sequence
  synthetic sequence
gaacaggggagcg

SEQ ID NO: 16168 - DNA, 13 bp, Artificial Sequence
  synthetic sequence
acttggttgagta

SEQ ID NO: 16169 - DNA, 13 bp, Artificial Sequence
  synthetic sequence
tcttgcggctaaa

SEQ ID NO: 16170 - DNA, 13 bp, Artificial Sequence
  synthetic sequence
acggaaaccatca

SEQ ID NO: 16171 - DNA, 13 bp, Artificial Sequence
  synthetic sequence
gtttccacccgta

SEQ ID NO: 16172 - DNA, 13 bp, Artificial Sequence
  synthetic sequence
tggcgtcgaggac

SEQ ID NO: 16173 - DNA, 13 bp, Artificial Sequence
  synthetic sequence
cgctgaacgagca

SEQ ID NO: 16174 - DNA, 13 bp, Artificial Sequence
  synthetic sequence
tggtcgtgctggt

SEQ ID NO: 16175 - DNA, 13 bp, Artificial Sequence
  synthetic sequence
gcgcaacgttgtt

SEQ ID NO: 16176 - DNA, 13 bp, Artificial Sequence
  synthetic sequence
tggtgccataatc

SEQ ID NO: 16177 - DNA, 13 bp, Artificial Sequence
  synthetic sequence
agatcccgtacga

SEQ ID NO: 16178 - DNA, 13 bp, Artificial Sequence
  synthetic sequence
accgcttcggtac

SEQ ID NO: 16179 - DNA, 13 bp, Artificial Sequence
  synthetic sequence
ggtgaagggccag

SEQ ID NO: 16180 - DNA, 13 bp, Artificial Sequence
  synthetic sequence
cgccttcgtcctg

SEQ ID NO: 16181 - DNA, 13 bp, Artificial Sequence
  synthetic sequence
actgccaattgca

SEQ ID NO: 16182 - DNA, 13 bp, Artificial Sequence
  synthetic sequence
gttgatcaggaag

SEQ ID NO: 16183 - DNA, 13 bp, Artificial Sequence
  synthetic sequence
tggtgaacatctt

SEQ ID NO: 16184 - DNA, 13 bp, Artificial Sequence
  synthetic sequence
tcgctacatttac

SEQ ID NO: 16185 - DNA, 13 bp, Artificial Sequence
  synthetic sequence
aatattgaccact

SEQ ID NO: 16186 - DNA, 13 bp, Artificial Sequence
  synthetic sequence
gtggttgctacac

SEQ ID NO: 16187 - DNA, 13 bp, Artificial Sequence
  synthetic sequence
cgttgcgcacgaa

SEQ ID NO: 16188 - DNA, 13 bp, Artificial Sequence
  synthetic sequence
gtgcaagtccata

SEQ ID NO: 16189 - DNA, 13 bp, Artificial Sequence
  synthetic sequence
attccagaatctc

SEQ ID NO: 16190 - DNA, 13 bp, Artificial Sequence
  synthetic sequence
agcaaccaaatgc

SEQ ID NO: 16191 - DNA, 13 bp, Artificial Sequence
  synthetic sequence
tgaatagcgcact

SEQ ID NO: 16192 - DNA, 13 bp, Artificial Sequence
  synthetic sequence
agataaggacttg

SEQ ID NO: 16193 - DNA, 13 bp, Artificial Sequence
  synthetic sequence
aaatcaattccgg

SEQ ID NO: 16194 - DNA, 13 bp, Artificial Sequence
  synthetic sequence
gttcccatcattg

SEQ ID NO: 16195 - DNA, 13 bp, Artificial Sequence
  synthetic sequence
caagtgaaaacga

SEQ ID NO: 16196 - DNA, 13 bp, Artificial Sequence
  synthetic sequence
gtatggcatggct

SEQ ID NO: 16197 - DNA, 13 bp, Artificial Sequence
  synthetic sequence
agcgttttctcct

SEQ ID NO: 16198 - DNA, 13 bp, Artificial Sequence
  synthetic sequence
aataatcatttcc

SEQ ID NO: 16199 - DNA, 13 bp, Artificial Sequence
  synthetic sequence
cgtacaatccttg

SEQ ID NO: 16200 - DNA, 13 bp, Artificial Sequence
  synthetic sequence
cgcgttttcagct

SEQ ID NO: 16201 - DNA, 13 bp, Artificial Sequence
  synthetic sequence
tggcgatgggtac

SEQ ID NO: 16202 - DNA, 13 bp, Artificial Sequence
  synthetic sequence
ttcccctttggca

SEQ ID NO: 16203 - DNA, 13 bp, Artificial Sequence
  synthetic sequence
tcattttcggcat

SEQ ID NO: 16204 - DNA, 13 bp, Artificial Sequence
  synthetic sequence
gacggcaacgtca

SEQ ID NO: 16205 - DNA, 13 bp, Artificial Sequence
  synthetic sequence
gaggtggacgtca

SEQ ID NO: 16206 - DNA, 13 bp, Artificial Sequence
  synthetic sequence
ctttcataaagtg

SEQ ID NO: 16207 - DNA, 13 bp, Artificial Sequence
  synthetic sequence
tccaggttggcgg

SEQ ID NO: 16208 - DNA, 13 bp, Artificial Sequence
  synthetic sequence
cgagcgtgcgatg

SEQ ID NO: 16209 - DNA, 13 bp, Artificial Sequence
  synthetic sequence
gtggccgggatga

SEQ ID NO: 16210 - DNA, 13 bp, Artificial Sequence
  synthetic sequence
cgaccagtcgctg

SEQ ID NO: 16211 - DNA, 13 bp, Artificial Sequence
  synthetic sequence
gcttgcgtaggct

SEQ ID NO: 16212 - DNA, 13 bp, Artificial Sequence
  synthetic sequence
cctggtaagcctg

SEQ ID NO: 16213 - DNA, 13 bp, Artificial Sequence
  synthetic sequence
taacgaggcgctg

SEQ ID NO: 16214 - DNA, 13 bp, Artificial Sequence
  synthetic sequence
cacggagccttgg

SEQ ID NO: 16215 - DNA, 13 bp, Artificial Sequence
  synthetic sequence
atagccggcggag

SEQ ID NO: 16216 - DNA, 13 bp, Artificial Sequence
  synthetic sequence
aagtggccacggc

SEQ ID NO: 16217 - DNA, 13 bp, Artificial Sequence
  synthetic sequence
cagggtgttgatc

SEQ ID NO: 16218 - DNA, 13 bp, Artificial Sequence
  synthetic sequence
gttatatactgat

SEQ ID NO: 16219 - DNA, 13 bp, Artificial Sequence
  synthetic sequence
aacggccaggaag

SEQ ID NO: 16220 - DNA, 13 bp, Artificial Sequence
  synthetic sequence
agctcgaaccagc

SEQ ID NO: 16221 - DNA, 13 bp, Artificial Sequence
  synthetic sequence
cactcctccattg

SEQ ID NO: 16222 - DNA, 13 bp, Artificial Sequence
  synthetic sequence
cataataacagct

SEQ ID NO: 16223 - DNA, 13 bp, Artificial Sequence
  synthetic sequence
gatcgggatcgcg

SEQ ID NO: 16224 - DNA, 13 bp, Artificial Sequence
  synthetic sequence
gtcggggtcatga

SEQ ID NO: 16225 - DNA, 13 bp, Artificial Sequence
  synthetic sequence
tctcgacgacggg

SEQ ID NO: 16226 - DNA, 13 bp, Artificial Sequence
  synthetic sequence
cctatctgcgcga

SEQ ID NO: 16227 - DNA, 13 bp, Artificial Sequence
  synthetic sequence
tatttggtggagt

SEQ ID NO: 16228 - DNA, 13 bp, Artificial Sequence
  synthetic sequence
atgtcgccaactt

SEQ ID NO: 16229 - DNA, 13 bp, Artificial Sequence
  synthetic sequence
ccacgacacctta

SEQ ID NO: 16230 - DNA, 13 bp, Artificial Sequence
  synthetic sequence
tcgctcgcgttga

SEQ ID NO: 16231 - DNA, 13 bp, Artificial Sequence
  synthetic sequence
ggcggacatgcat

SEQ ID NO: 16232 - DNA, 13 bp, Artificial Sequence
  synthetic sequence
gtctgctcaaggg

SEQ ID NO: 16233 - DNA, 13 bp, Artificial Sequence
  synthetic sequence
cattgctggtgtg

SEQ ID NO: 16234 - DNA, 13 bp, Artificial Sequence
  synthetic sequence
aggaactcggtca

SEQ ID NO: 16235 - DNA, 13 bp, Artificial Sequence
  synthetic sequence
taagcactttctg

SEQ ID NO: 16236 - DNA, 13 bp, Artificial Sequence
  synthetic sequence
ctatgctggggtt

SEQ ID NO: 16237 - DNA, 13 bp, Artificial Sequence
  synthetic sequence
cacttgctgactt

SEQ ID NO: 16238 - DNA, 13 bp, Artificial Sequence
  synthetic sequence
gcactgctcaggg

SEQ ID NO: 16239 - DNA, 13 bp, Artificial Sequence
  synthetic sequence
catgtagagcgcg

SEQ ID NO: 16240 - DNA, 13 bp, Artificial Sequence
  synthetic sequence
cgttattcgatgc

SEQ ID NO: 16241 - DNA, 13 bp, Artificial Sequence
  synthetic sequence
tacgcccgtggtc

SEQ ID NO: 16242 - DNA, 13 bp, Artificial Sequence
  synthetic sequence
tcgaacagaatat

SEQ ID NO: 16243 - DNA, 13 bp, Artificial Sequence
  synthetic sequence
cgctggttccgtg

SEQ ID NO: 16244 - DNA, 13 bp, Artificial Sequence
  synthetic sequence
ctcccagccaagt

SEQ ID NO: 16245 - DNA, 13 bp, Artificial Sequence
  synthetic sequence
gcggaccacgttc

SEQ ID NO: 16246 - DNA, 13 bp, Artificial Sequence
  synthetic sequence
gcaggtattcgcg

SEQ ID NO: 16247 - DNA, 13 bp, Artificial Sequence
  synthetic sequence
caatatgctgggc

SEQ ID NO: 16248 - DNA, 13 bp, Artificial Sequence
  synthetic sequence
gttgcgggagaag

SEQ ID NO: 16249 - DNA, 13 bp, Artificial Sequence
  synthetic sequence
caatggcgttaat

SEQ ID NO: 16250 - DNA, 13 bp, Artificial Sequence
  synthetic sequence
ttcgcgatgacga

SEQ ID NO: 16251 - DNA, 13 bp, Artificial Sequence
  synthetic sequence
cgtagtcaacaac

SEQ ID NO: 16252 - DNA, 13 bp, Artificial Sequence
  synthetic sequence
atcactcggcatg

SEQ ID NO: 16253 - DNA, 13 bp, Artificial Sequence
  synthetic sequence
tgcttttaaggtt

SEQ ID NO: 16254 - DNA, 13 bp, Artificial Sequence
  synthetic sequence
tggaacggcagct

SEQ ID NO: 16255 - DNA, 13 bp, Artificial Sequence
  synthetic sequence
tttaccgtggcgt

SEQ ID NO: 16256 - DNA, 13 bp, Artificial Sequence
  synthetic sequence
tgacgggacgtat

SEQ ID NO: 16257 - DNA, 13 bp, Artificial Sequence
  synthetic sequence
aggaaagctgcct

SEQ ID NO: 16258 - DNA, 13 bp, Artificial Sequence
  synthetic sequence
ctaggttttaatt

SEQ ID NO: 16259 - DNA, 13 bp, Artificial Sequence
  synthetic sequence
taacttttgtttg

SEQ ID NO: 16260 - DNA, 13 bp, Artificial Sequence
  synthetic sequence
caccgtctgaccc

SEQ ID NO: 16261 - DNA, 13 bp, Artificial Sequence
  synthetic sequence
ttttgcttgggtt

SEQ ID NO: 16262 - DNA, 13 bp, Artificial Sequence
  synthetic sequence
ttaagaagcgcta

SEQ ID NO: 16263 - DNA, 13 bp, Artificial Sequence
  synthetic sequence
agtcccagttgct

SEQ ID NO: 16264 - DNA, 13 bp, Artificial Sequence
  synthetic sequence
acaataatcgtca

SEQ ID NO: 16265 - DNA, 13 bp, Artificial Sequence
  synthetic sequence
agcaatagttaat

SEQ ID NO: 16266 - DNA, 13 bp, Artificial Sequence
  synthetic sequence
gttcctctttggc

SEQ ID NO: 16267 - DNA, 13 bp, Artificial Sequence
  synthetic sequence
atcttgaaattca

SEQ ID NO: 16268 - DNA, 13 bp, Artificial Sequence
  synthetic sequence
gctgttgtccttc

SEQ ID NO: 16269 - DNA, 13 bp, Artificial Sequence
  synthetic sequence
ctggtggtgtccc

SEQ ID NO: 16270 - DNA, 13 bp, Artificial Sequence
  synthetic sequence
gttgcgccattgg

SEQ ID NO: 16271 - DNA, 13 bp, Artificial Sequence
  synthetic sequence
gctgccgcaggaa

SEQ ID NO: 16272 - DNA, 13 bp, Artificial Sequence
  synthetic sequence
taaagattttgct

SEQ ID NO: 16273 - DNA, 13 bp, Artificial Sequence
  synthetic sequence
ccgtggggatctg

SEQ ID NO: 16274 - DNA, 13 bp, Artificial Sequence
  synthetic sequence
gtgcacaccctgt

SEQ ID NO: 16275 - DNA, 13 bp, Artificial Sequence
  synthetic sequence
tttcaggtgtcct

SEQ ID NO: 16276 - DNA, 13 bp, Artificial Sequence
  synthetic sequence
cagcggatttcgt

SEQ ID NO: 16277 - DNA, 13 bp, Artificial Sequence
  synthetic sequence
atgactttcacag

SEQ ID NO: 16278 - DNA, 13 bp, Artificial Sequence
  synthetic sequence
catttggcacccc

SEQ ID NO: 16279 - DNA, 13 bp, Artificial Sequence
  synthetic sequence
tctacacttgaag

SEQ ID NO: 16280 - DNA, 13 bp, Artificial Sequence
  synthetic sequence
tcgatccggagcg

SEQ ID NO: 16281 - DNA, 13 bp, Artificial Sequence
  synthetic sequence
tgcctcaacgcgt

SEQ ID NO: 16282 - DNA, 13 bp, Artificial Sequence
  synthetic sequence
tttaccgacctgt

SEQ ID NO: 16283 - DNA, 13 bp, Artificial Sequence
  synthetic sequence
gcctgtcgccaag

SEQ ID NO: 16284 - DNA, 13 bp, Artificial Sequence
  synthetic sequence
cgtgcgttccagc

SEQ ID NO: 16285 - DNA, 13 bp, Artificial Sequence
  synthetic sequence
atgatatcctctt

SEQ ID NO: 16286 - DNA, 13 bp, Artificial Sequence
  synthetic sequence
cagcatttgcttt

SEQ ID NO: 16287 - DNA, 13 bp, Artificial Sequence
  synthetic sequence
cttagcatattta

SEQ ID NO: 16288 - DNA, 13 bp, Artificial Sequence
  synthetic sequence
tcaaacgatcacg

SEQ ID NO: 16289 - DNA, 13 bp, Artificial Sequence
  synthetic sequence
tttcggcttcagc

SEQ ID NO: 16290 - DNA, 13 bp, Artificial Sequence
  synthetic sequence
tgatgctgttgtc

SEQ ID NO: 16291 - DNA, 13 bp, Artificial Sequence
  synthetic sequence
cgccgcgttcgtt

SEQ ID NO: 16292 - DNA, 13 bp, Artificial Sequence
  synthetic sequence
tcgaacatgcggt

SEQ ID NO: 16293 - DNA, 13 bp, Artificial Sequence
  synthetic sequence
cccagctgcaaca

SEQ ID NO: 16294 - DNA, 13 bp, Artificial Sequence
  synthetic sequence
gaacagcagtata

SEQ ID NO: 16295 - DNA, 13 bp, Artificial Sequence
  synthetic sequence
gtcgtgattgtct

SEQ ID NO: 16296 - DNA, 13 bp, Artificial Sequence
  synthetic sequence
ggtcagatagtat

SEQ ID NO: 16297 - DNA, 13 bp, Artificial Sequence
  synthetic sequence
ggacgtcgattgc

SEQ ID NO: 16298 - DNA, 13 bp, Artificial Sequence
  synthetic sequence
aacgaggagtgga

SEQ ID NO: 16299 - DNA, 13 bp, Artificial Sequence
  synthetic sequence
gcttcgaattgcg

SEQ ID NO: 16300 - DNA, 13 bp, Artificial Sequence
  synthetic sequence
tggcggtgaagcc

SEQ ID NO: 16301 - DNA, 13 bp, Artificial Sequence
  synthetic sequence
gctttggatattt

SEQ ID NO: 16302 - DNA, 13 bp, Artificial Sequence
  synthetic sequence
cggctggaaatcg

SEQ ID NO: 16303 - DNA, 13 bp, Artificial Sequence
  synthetic sequence
acatcagcttatc

SEQ ID NO: 16304 - DNA, 13 bp, Artificial Sequence
  synthetic sequence
catgcccacccgt

SEQ ID NO: 16305 - DNA, 13 bp, Artificial Sequence
  synthetic sequence
cgccccagacatt

SEQ ID NO: 16306 - DNA, 13 bp, Artificial Sequence
  synthetic sequence
ataacagtgatgt

SEQ ID NO: 16307 - DNA, 13 bp, Artificial Sequence
  synthetic sequence
gccgatcgcgatc

SEQ ID NO: 16308 - DNA, 13 bp, Artificial Sequence
  synthetic sequence
gcttgagcacgtg

SEQ ID NO: 16309 - DNA, 13 bp, Artificial Sequence
  synthetic sequence
ttggcgaccaggc

SEQ ID NO: 16310 - DNA, 13 bp, Artificial Sequence
  synthetic sequence
tcgaggtcgctgt

SEQ ID NO: 16311 - DNA, 13 bp, Artificial Sequence
  synthetic sequence
gatgccccaatgc

SEQ ID NO: 16312 - DNA, 13 bp, Artificial Sequence
  synthetic sequence
ttcgtaggtcacg

SEQ ID NO: 16313 - DNA, 13 bp, Artificial Sequence
  synthetic sequence
gcggtagatcgcc

SEQ ID NO: 16314 - DNA, 13 bp, Artificial Sequence
  synthetic sequence
gctcctggcgctt

SEQ ID NO: 16315 - DNA, 13 bp, Artificial Sequence
  synthetic sequence
accccgccaccta

SEQ ID NO: 16316 - DNA, 13 bp, Artificial Sequence
  synthetic sequence
tatggggcagaac

SEQ ID NO: 16317 - DNA, 13 bp, Artificial Sequence
  synthetic sequence
actggattggtac

SEQ ID NO: 16318 - DNA, 13 bp, Artificial Sequence
  synthetic sequence
cggtgagaatggc

SEQ ID NO: 16319 - DNA, 13 bp, Artificial Sequence
  synthetic sequence
gtggaaatcgcca

SEQ ID NO: 16320 - DNA, 13 bp, Artificial Sequence
  synthetic sequence
cacgctgcgcatc

SEQ ID NO: 16321 - DNA, 13 bp, Artificial Sequence
  synthetic sequence
aaggataaggcca

SEQ ID NO: 16322 - DNA, 13 bp, Artificial Sequence
  synthetic sequence
attgaattagaca

SEQ ID NO: 16323 - DNA, 13 bp, Artificial Sequence
  synthetic sequence
agtcgcattcggc

SEQ ID NO: 16324 - DNA, 13 bp, Artificial Sequence
  synthetic sequence
catattgttctaa

SEQ ID NO: 16325 - DNA, 13 bp, Artificial Sequence
  synthetic sequence
tctgcatcaaagg

SEQ ID NO: 16326 - DNA, 13 bp, Artificial Sequence
  synthetic sequence
tggcgatgtccgc

SEQ ID NO: 16327 - DNA, 13 bp, Artificial Sequence
  synthetic sequence
atcgtgccagagg

SEQ ID NO: 16328 - DNA, 13 bp, Artificial Sequence
  synthetic sequence
ggacacgctgtgg

SEQ ID NO: 16329 - DNA, 13 bp, Artificial Sequence
  synthetic sequence
cgaagcgatggtc

SEQ ID NO: 16330 - DNA, 13 bp, Artificial Sequence
  synthetic sequence
tcgccatttccga

SEQ ID NO: 16331 - DNA, 13 bp, Artificial Sequence
  synthetic sequence
gatcactggtgcc

SEQ ID NO: 16332 - DNA, 13 bp, Artificial Sequence
  synthetic sequence
ttacttcccaacc

SEQ ID NO: 16333 - DNA, 13 bp, Artificial Sequence
  synthetic sequence
tagcagtgaagta

SEQ ID NO: 16334 - DNA, 13 bp, Artificial Sequence
  synthetic sequence
tagttgtgtgttg

SEQ ID NO: 16335 - DNA, 13 bp, Artificial Sequence
  synthetic sequence
ttctgcgcgagct

SEQ ID NO: 16336 - DNA, 13 bp, Artificial Sequence
  synthetic sequence
ccagcatcaagct

SEQ ID NO: 16337 - DNA, 13 bp, Artificial Sequence
  synthetic sequence
gagtctggctcat

SEQ ID NO: 16338 - DNA, 13 bp, Artificial Sequence
  synthetic sequence
cagcttccgtgag

SEQ ID NO: 16339 - DNA, 13 bp, Artificial Sequence
  synthetic sequence
ggaattgtggatg

SEQ ID NO: 16340 - DNA, 13 bp, Artificial Sequence
  synthetic sequence
tttcggcaaagcc

SEQ ID NO: 16341 - DNA, 13 bp, Artificial Sequence
  synthetic sequence
gacagtgttattc

SEQ ID NO: 16342 - DNA, 13 bp, Artificial Sequence
  synthetic sequence
acttttcgtcggt

SEQ ID NO: 16343 - DNA, 13 bp, Artificial Sequence
  synthetic sequence
atgtgagcggtaa

SEQ ID NO: 16344 - DNA, 13 bp, Artificial Sequence
  synthetic sequence
gaccctcgatgct

SEQ ID NO: 16345 - DNA, 13 bp, Artificial Sequence
  synthetic sequence
ggtccatgctcgt

SEQ ID NO: 16346 - DNA, 13 bp, Artificial Sequence
  synthetic sequence
gcattcgttgcta

SEQ ID NO: 16347 - DNA, 13 bp, Artificial Sequence
  synthetic sequence
ccgttgtaacgtt

SEQ ID NO: 16348 - DNA, 13 bp, Artificial Sequence
  synthetic sequence
gctgcaacgacag

SEQ ID NO: 16349 - DNA, 13 bp, Artificial Sequence
  synthetic sequence
agtagtgagttaa

SEQ ID NO: 16350 - DNA, 13 bp, Artificial Sequence
  synthetic sequence
atcgaaccgcgcc

SEQ ID NO: 16351 - DNA, 13 bp, Artificial Sequence
  synthetic sequence
gaaacccggcttt

SEQ ID NO: 16352 - DNA, 13 bp, Artificial Sequence
  synthetic sequence
gcgagcaccagga

SEQ ID NO: 16353 - DNA, 13 bp, Artificial Sequence
  synthetic sequence
gtcgtagtcgaaa

SEQ ID NO: 16354 - DNA, 13 bp, Artificial Sequence
  synthetic sequence
gtgctgcatgaaa

SEQ ID NO: 16355 - DNA, 13 bp, Artificial Sequence
  synthetic sequence
cgtccgtactctg

SEQ ID NO: 16356 - DNA, 13 bp, Artificial Sequence
  synthetic sequence
agaagagctctac

SEQ ID NO: 16357 - DNA, 13 bp, Artificial Sequence
  synthetic sequence
tctggttggcgaa

SEQ ID NO: 16358 - DNA, 13 bp, Artificial Sequence
  synthetic sequence
gctcaactccctg

SEQ ID NO: 16359 - DNA, 13 bp, Artificial Sequence
  synthetic sequence
ctggtcgaagcga

SEQ ID NO: 16360 - DNA, 13 bp, Artificial Sequence
  synthetic sequence
tttgtttgggtgt

SEQ ID NO: 16361 - DNA, 13 bp, Artificial Sequence
  synthetic sequence
cggtgttctgttc

SEQ ID NO: 16362 - DNA, 13 bp, Artificial Sequence
  synthetic sequence
gaggggatagcag

SEQ ID NO: 16363 - DNA, 13 bp, Artificial Sequence
  synthetic sequence
ggcctgcatattc

SEQ ID NO: 16364 - DNA, 13 bp, Artificial Sequence
  synthetic sequence
cgccatcctcctg

SEQ ID NO: 16365 - DNA, 13 bp, Artificial Sequence
  synthetic sequence
tactattagctgg

SEQ ID NO: 16366 - DNA, 13 bp, Artificial Sequence
  synthetic sequence
atccaggatccgc

SEQ ID NO: 16367 - DNA, 13 bp, Artificial Sequence
  synthetic sequence
cgatgtaccacca

SEQ ID NO: 16368 - DNA, 13 bp, Artificial Sequence
  synthetic sequence
gcgctgatgctca

SEQ ID NO: 16369 - DNA, 13 bp, Artificial Sequence
  synthetic sequence
gttttcggaacgt

SEQ ID NO: 16370 - DNA, 13 bp, Artificial Sequence
  synthetic sequence
taggcattgaatc

SEQ ID NO: 16371 - DNA, 13 bp, Artificial Sequence
  synthetic sequence
cgctgcgtaaggt

SEQ ID NO: 16372 - DNA, 13 bp, Artificial Sequence
  synthetic sequence
tcgaatcctcgaa

SEQ ID NO: 16373 - DNA, 13 bp, Artificial Sequence
  synthetic sequence
gtcgcctggttgt

SEQ ID NO: 16374 - DNA, 13 bp, Artificial Sequence
  synthetic sequence
catgtctcaaaat

SEQ ID NO: 16375 - DNA, 13 bp, Artificial Sequence
  synthetic sequence
cgtactttctgca

SEQ ID NO: 16376 - DNA, 13 bp, Artificial Sequence
  synthetic sequence
gaagaatactggc

SEQ ID NO: 16377 - DNA, 13 bp, Artificial Sequence
  synthetic sequence
ttaattgtcggta

SEQ ID NO: 16378 - DNA, 13 bp, Artificial Sequence
  synthetic sequence
ccatagcgttaag

SEQ ID NO: 16379 - DNA, 13 bp, Artificial Sequence
  synthetic sequence
aaggagcgaagcg

SEQ ID NO: 16380 - DNA, 13 bp, Artificial Sequence
  synthetic sequence
cacgtcgactttc

SEQ ID NO: 16381 - DNA, 13 bp, Artificial Sequence
  synthetic sequence
ttttgaatatgtg

SEQ ID NO: 16382 - DNA, 13 bp, Artificial Sequence
  synthetic sequence
aggccacaccgaa

SEQ ID NO: 16383 - DNA, 13 bp, Artificial Sequence
  synthetic sequence
cggtattgccgtt

SEQ ID NO: 16384 - DNA, 13 bp, Artificial Sequence
  synthetic sequence
caggcctacgaga

SEQ ID NO: 16385 - DNA, 13 bp, Artificial Sequence
  synthetic sequence
tcgacgcgtacca

SEQ ID NO: 16386 - DNA, 13 bp, Artificial Sequence
  synthetic sequence
ccaatgcaccttc

SEQ ID NO: 16387 - DNA, 13 bp, Artificial Sequence
  synthetic sequence
ggatgagatgcga

SEQ ID NO: 16388 - DNA, 13 bp, Artificial Sequence
  synthetic sequence
atgctcgtgcagc

SEQ ID NO: 16389 - DNA, 13 bp, Artificial Sequence
  synthetic sequence
tgctccagcgtgg

SEQ ID NO: 16390 - DNA, 13 bp, Artificial Sequence
  synthetic sequence
atttcccttgaaa

SEQ ID NO: 16391 - DNA, 13 bp, Artificial Sequence
  synthetic sequence
ctaaaacaactat

SEQ ID NO: 16392 - DNA, 13 bp, Artificial Sequence
  synthetic sequence
actgcacagccac

SEQ ID NO: 16393 - DNA, 13 bp, Artificial Sequence
  synthetic sequence
ttcatcgtccgga

SEQ ID NO: 16394 - DNA, 13 bp, Artificial Sequence
  synthetic sequence
acgaatgcctggt

SEQ ID NO: 16395 - DNA, 13 bp, Artificial Sequence
  synthetic sequence
gagtatatcccct

SEQ ID NO: 16396 - DNA, 13 bp, Artificial Sequence
  synthetic sequence
gagcctgcgccat

SEQ ID NO: 16397 - DNA, 13 bp, Artificial Sequence
  synthetic sequence
aatctgggaggta

SEQ ID NO: 16398 - DNA, 13 bp, Artificial Sequence
  synthetic sequence
gtcgcgctcaacc

SEQ ID NO: 16399 - DNA, 13 bp, Artificial Sequence
  synthetic sequence
tatacgatggtgg

SEQ ID NO: 16400 - DNA, 13 bp, Artificial Sequence
  synthetic sequence
gcttttatgcttg

SEQ ID NO: 16401 - DNA, 13 bp, Artificial Sequence
  synthetic sequence
cttgcagagcctg

SEQ ID NO: 16402 - DNA, 13 bp, Artificial Sequence
  synthetic sequence
ttttctgatgccc

SEQ ID NO: 16403 - DNA, 13 bp, Artificial Sequence
  synthetic sequence
cacagggaggaat

SEQ ID NO: 16404 - DNA, 13 bp, Artificial Sequence
  synthetic sequence
gacgttggccatg

SEQ ID NO: 16405 - DNA, 13 bp, Artificial Sequence
  synthetic sequence
tcagataatccga

SEQ ID NO: 16406 - DNA, 13 bp, Artificial Sequence
  synthetic sequence
aggatgagaggct

SEQ ID NO: 16407 - DNA, 13 bp, Artificial Sequence
  synthetic sequence
ctgttgccaactt

SEQ ID NO: 16408 - DNA, 13 bp, Artificial Sequence
  synthetic sequence
ttctggcttatca

SEQ ID NO: 16409 - DNA, 13 bp, Artificial Sequence
  synthetic sequence
aagatcataccgg

SEQ ID NO: 16410 - DNA, 13 bp, Artificial Sequence
  synthetic sequence
catgagagtgact

SEQ ID NO: 16411 - DNA, 13 bp, Artificial Sequence
  synthetic sequence
gtccaaccttctt

SEQ ID NO: 16412 - DNA, 13 bp, Artificial Sequence
  synthetic sequence
tcgggctcttgac

SEQ ID NO: 16413 - DNA, 13 bp, Artificial Sequence
  synthetic sequence
attaatggcactt

SEQ ID NO: 16414 - DNA, 13 bp, Artificial Sequence
  synthetic sequence
catatcatgaaag

SEQ ID NO: 16415 - DNA, 13 bp, Artificial Sequence
  synthetic sequence
gcggaacgacgtc

SEQ ID NO: 16416 - DNA, 13 bp, Artificial Sequence
  synthetic sequence
aaaggcaaaatat

SEQ ID NO: 16417 - DNA, 13 bp, Artificial Sequence
  synthetic sequence
aaacatggaaaag

SEQ ID NO: 16418 - DNA, 13 bp, Artificial Sequence
  synthetic sequence
gtgcgctggtcac

SEQ ID NO: 16419 - DNA, 13 bp, Artificial Sequence
  synthetic sequence
gtaataacttgac

SEQ ID NO: 16420 - DNA, 13 bp, Artificial Sequence
  synthetic sequence
aaggttaattgga

SEQ ID NO: 16421 - DNA, 13 bp, Artificial Sequence
  synthetic sequence
aacgtgtggcgtc

SEQ ID NO: 16422 - DNA, 13 bp, Artificial Sequence
  synthetic sequence
gcggaggcacgat

SEQ ID NO: 16423 - DNA, 13 bp, Artificial Sequence
  synthetic sequence
ctgattagcggta

SEQ ID NO: 16424 - DNA, 13 bp, Artificial Sequence
  synthetic sequence
tagaatatgcacc

SEQ ID NO: 16425 - DNA, 13 bp, Artificial Sequence
  synthetic sequence
ccgaatgtcggtt

SEQ ID NO: 16426 - DNA, 13 bp, Artificial Sequence
  synthetic sequence
agcactcttggtg

SEQ ID NO: 16427 - DNA, 13 bp, Artificial Sequence
  synthetic sequence
gcggcgaatcttt

SEQ ID NO: 16428 - DNA, 13 bp, Artificial Sequence
  synthetic sequence
atggtggtattct

SEQ ID NO: 16429 - DNA, 13 bp, Artificial Sequence
  synthetic sequence
ctgcggacgacga

SEQ ID NO: 16430 - DNA, 13 bp, Artificial Sequence
  synthetic sequence
cggagttcatcgg

SEQ ID NO: 16431 - DNA, 13 bp, Artificial Sequence
  synthetic sequence
attaagcagactg

SEQ ID NO: 16432 - DNA, 13 bp, Artificial Sequence
  synthetic sequence
tggctccttgtgc

SEQ ID NO: 16433 - DNA, 13 bp, Artificial Sequence
  synthetic sequence
tgagttgcttctt

SEQ ID NO: 16434 - DNA, 13 bp, Artificial Sequence
  synthetic sequence
ccaggtgagcgga

SEQ ID NO: 16435 - DNA, 13 bp, Artificial Sequence
  synthetic sequence
catgaagcaaata

SEQ ID NO: 16436 - DNA, 13 bp, Artificial Sequence
  synthetic sequence
ggattctcctcgt

SEQ ID NO: 16437 - DNA, 13 bp, Artificial Sequence
  synthetic sequence
gttcgatcctgcc

SEQ ID NO: 16438 - DNA, 13 bp, Artificial Sequence
  synthetic sequence
aacgcttttaaac

SEQ ID NO: 16439 - DNA, 13 bp, Artificial Sequence
  synthetic sequence
caccgccacgaaa

SEQ ID NO: 16440 - DNA, 13 bp, Artificial Sequence
  synthetic sequence
gaacgcaaacttg

SEQ ID NO: 16441 - DNA, 13 bp, Artificial Sequence
  synthetic sequence
tcgccttcggcct

SEQ ID NO: 16442 - DNA, 13 bp, Artificial Sequence
  synthetic sequence
cattgccgatcgc

SEQ ID NO: 16443 - DNA, 13 bp, Artificial Sequence
  synthetic sequence
ctgcagcttgaag

SEQ ID NO: 16444 - DNA, 13 bp, Artificial Sequence
  synthetic sequence
aatgtctgaagag

SEQ ID NO: 16445 - DNA, 13 bp, Artificial Sequence
  synthetic sequence
gaaagcgcgaaag

SEQ ID NO: 16446 - DNA, 13 bp, Artificial Sequence
  synthetic sequence
aaacggattagaa

SEQ ID NO: 16447 - DNA, 13 bp, Artificial Sequence
  synthetic sequence
tcggcaccaggct

SEQ ID NO: 16448 - DNA, 13 bp, Artificial Sequence
  synthetic sequence
gcagctccatcac

SEQ ID NO: 16449 - DNA, 13 bp, Artificial Sequence
  synthetic sequence
agcacgaacatct

SEQ ID NO: 16450 - DNA, 13 bp, Artificial Sequence
  synthetic sequence
gcgcgtctgttat

SEQ ID NO: 16451 - DNA, 13 bp, Artificial Sequence
  synthetic sequence
gagtgctggtgag

SEQ ID NO: 16452 - DNA, 13 bp, Artificial Sequence
  synthetic sequence
cgatcaaggattc

SEQ ID NO: 16453 - DNA, 13 bp, Artificial Sequence
  synthetic sequence
gcagtaatttggc

SEQ ID NO: 16454 - DNA, 13 bp, Artificial Sequence
  synthetic sequence
tagtttaggcgtt

SEQ ID NO: 16455 - DNA, 13 bp, Artificial Sequence
  synthetic sequence
agccaaatagcga

SEQ ID NO: 16456 - DNA, 13 bp, Artificial Sequence
  synthetic sequence
gttttgttacctc

SEQ ID NO: 16457 - DNA, 13 bp, Artificial Sequence
  synthetic sequence
acggagaatggaa

SEQ ID NO: 16458 - DNA, 13 bp, Artificial Sequence
  synthetic sequence
tacgcctacttcg

SEQ ID NO: 16459 - DNA, 13 bp, Artificial Sequence
  synthetic sequence
cgcttcatgaact

SEQ ID NO: 16460 - DNA, 13 bp, Artificial Sequence
  synthetic sequence
tagttagagtaag

SEQ ID NO: 16461 - DNA, 13 bp, Artificial Sequence
  synthetic sequence
tgcgcggtcagta

SEQ ID NO: 16462 - DNA, 13 bp, Artificial Sequence
  synthetic sequence
cgggtcgaaggtg

SEQ ID NO: 16463 - DNA, 13 bp, Artificial Sequence
  synthetic sequence
tcagctcaccgat

SEQ ID NO: 16464 - DNA, 13 bp, Artificial Sequence
  synthetic sequence
cgtttgtgccata

SEQ ID NO: 16465 - DNA, 13 bp, Artificial Sequence
  synthetic sequence
ttcctttgggtag

SEQ ID NO: 16466 - DNA, 13 bp, Artificial Sequence
  synthetic sequence
cggtgcgcaggaa

SEQ ID NO: 16467 - DNA, 13 bp, Artificial Sequence
  synthetic sequence
gagatagcagaaa

SEQ ID NO: 16468 - DNA, 13 bp, Artificial Sequence
  synthetic sequence
gaaagggtggaga

SEQ ID NO: 16469 - DNA, 13 bp, Artificial Sequence
  synthetic sequence
ggccatcaacgcg

SEQ ID NO: 16470 - DNA, 13 bp, Artificial Sequence
  synthetic sequence
gccacaaccgtca

SEQ ID NO: 16471 - DNA, 13 bp, Artificial Sequence
  synthetic sequence
cgtaggtggcata

SEQ ID NO: 16472 - DNA, 13 bp, Artificial Sequence
  synthetic sequence
atactgagattct

SEQ ID NO: 16473 - DNA, 13 bp, Artificial Sequence
  synthetic sequence
gcgtgagttgctg

SEQ ID NO: 16474 - DNA, 13 bp, Artificial Sequence
  synthetic sequence
aattagaaagctg

SEQ ID NO: 16475 - DNA, 13 bp, Artificial Sequence
  synthetic sequence
aaaggcgcgtttt

SEQ ID NO: 16476 - DNA, 13 bp, Artificial Sequence
  synthetic sequence
tagaaacccgcaa

SEQ ID NO: 16477 - DNA, 13 bp, Artificial Sequence
  synthetic sequence
tgtgctgacgctg

SEQ ID NO: 16478 - DNA, 13 bp, Artificial Sequence
  synthetic sequence
agtttggttgccc

SEQ ID NO: 16479 - DNA, 13 bp, Artificial Sequence
  synthetic sequence
atagatcgaccca

SEQ ID NO: 16480 - DNA, 13 bp, Artificial Sequence
  synthetic sequence
aattgtacctctg

SEQ ID NO: 16481 - DNA, 13 bp, Artificial Sequence
  synthetic sequence
tttcgacaatgca

SEQ ID NO: 16482 - DNA, 13 bp, Artificial Sequence
  synthetic sequence
tgggcgtgttgtt

SEQ ID NO: 16483 - DNA, 13 bp, Artificial Sequence
  synthetic sequence
tgaagctgttatc

SEQ ID NO: 16484 - DNA, 13 bp, Artificial Sequence
  synthetic sequence
ctgcacggcaaaa

SEQ ID NO: 16485 - DNA, 13 bp, Artificial Sequence
  synthetic sequence
ttgaccctggcct

SEQ ID NO: 16486 - DNA, 13 bp, Artificial Sequence
  synthetic sequence
gtcaacatcccca

SEQ ID NO: 16487 - DNA, 13 bp, Artificial Sequence
  synthetic sequence
catgcaccgcgac

SEQ ID NO: 16488 - DNA, 13 bp, Artificial Sequence
  synthetic sequence
agttaaacgggcg

SEQ ID NO: 16489 - DNA, 13 bp, Artificial Sequence
  synthetic sequence
tttgaaccactgt

SEQ ID NO: 16490 - DNA, 13 bp, Artificial Sequence
  synthetic sequence
ctgctcatcaccc

SEQ ID NO: 16491 - DNA, 13 bp, Artificial Sequence
  synthetic sequence
acagttgcagcgt

SEQ ID NO: 16492 - DNA, 13 bp, Artificial Sequence
  synthetic sequence
gaccgtaattatc

SEQ ID NO: 16493 - DNA, 13 bp, Artificial Sequence
  synthetic sequence
tcttcactagttc

SEQ ID NO: 16494 - DNA, 13 bp, Artificial Sequence
  synthetic sequence
tcctcggcaccgt

SEQ ID NO: 16495 - DNA, 13 bp, Artificial Sequence
  synthetic sequence
tggacaggtctcc

SEQ ID NO: 16496 - DNA, 13 bp, Artificial Sequence
  synthetic sequence
tgccattgccata

SEQ ID NO: 16497 - DNA, 13 bp, Artificial Sequence
  synthetic sequence
ctacggcaacatc

SEQ ID NO: 16498 - DNA, 13 bp, Artificial Sequence
  synthetic sequence
accacgatatggg

SEQ ID NO: 16499 - DNA, 13 bp, Artificial Sequence
  synthetic sequence
atattgacggcaa

SEQ ID NO: 16500 - DNA, 13 bp, Artificial Sequence
  synthetic sequence
ttacaacggactg

SEQ ID NO: 16501 - DNA, 13 bp, Artificial Sequence
  synthetic sequence
cagtgataaagaa

SEQ ID NO: 16502 - DNA, 13 bp, Artificial Sequence
  synthetic sequence
cggtacggcgaag

SEQ ID NO: 16503 - DNA, 13 bp, Artificial Sequence
  synthetic sequence
ttccttcttcgcg

SEQ ID NO: 16504 - DNA, 13 bp, Artificial Sequence
  synthetic sequence
taaaagcgaatat

SEQ ID NO: 16505 - DNA, 13 bp, Artificial Sequence
  synthetic sequence
ggatgcgctcggt

SEQ ID NO: 16506 - DNA, 13 bp, Artificial Sequence
  synthetic sequence
gctgccccacttg

SEQ ID NO: 16507 - DNA, 13 bp, Artificial Sequence
  synthetic sequence
aatcgactcaata

SEQ ID NO: 16508 - DNA, 13 bp, Artificial Sequence
  synthetic sequence
acatgccggtaga

SEQ ID NO: 16509 - DNA, 13 bp, Artificial Sequence
  synthetic sequence
acctcccaactgt

SEQ ID NO: 16510 - DNA, 13 bp, Artificial Sequence
  synthetic sequence
agccgctgttcca

SEQ ID NO: 16511 - DNA, 13 bp, Artificial Sequence
  synthetic sequence
acaccacagccca

SEQ ID NO: 16512 - DNA, 13 bp, Artificial Sequence
  synthetic sequence
ggccttgtggaag

SEQ ID NO: 16513 - DNA, 13 bp, Artificial Sequence
  synthetic sequence
cttgttttcggta

SEQ ID NO: 16514 - DNA, 13 bp, Artificial Sequence
  synthetic sequence
tgagtatagcttt

SEQ ID NO: 16515 - DNA, 13 bp, Artificial Sequence
  synthetic sequence
ttcgacgttttga

SEQ ID NO: 16516 - DNA, 13 bp, Artificial Sequence
  synthetic sequence
taagccaatgcca

SEQ ID NO: 16517 - DNA, 13 bp, Artificial Sequence
  synthetic sequence
acgccaaagccga

SEQ ID NO: 16518 - DNA, 13 bp, Artificial Sequence
  synthetic sequence
tctgtaatcaaag

SEQ ID NO: 16519 - DNA, 13 bp, Artificial Sequence
  synthetic sequence
tcggggatattaa

SEQ ID NO: 16520 - DNA, 13 bp, Artificial Sequence
  synthetic sequence
accgccaatacta

SEQ ID NO: 16521 - DNA, 13 bp, Artificial Sequence
  synthetic sequence
agctatatcgaag

SEQ ID NO: 16522 - DNA, 13 bp, Artificial Sequence
  synthetic sequence
tttatcttcttca

SEQ ID NO: 16523 - DNA, 13 bp, Artificial Sequence
  synthetic sequence
aagcgcacctcga

SEQ ID NO: 16524 - DNA, 13 bp, Artificial Sequence
  synthetic sequence
cagctacgagtgg

SEQ ID NO: 16525 - DNA, 13 bp, Artificial Sequence
  synthetic sequence
acagaaagactaa

SEQ ID NO: 16526 - DNA, 13 bp, Artificial Sequence
  synthetic sequence
ggacatgaccaca

SEQ ID NO: 16527 - DNA, 13 bp, Artificial Sequence
  synthetic sequence
ccagtcagctcct

SEQ ID NO: 16528 - DNA, 13 bp, Artificial Sequence
  synthetic sequence
gaagccatcacat

SEQ ID NO: 16529 - DNA, 13 bp, Artificial Sequence
  synthetic sequence
tcaacacccaggg

SEQ ID NO: 16530 - DNA, 13 bp, Artificial Sequence
  synthetic sequence
cctggagcgctac

SEQ ID NO: 16531 - DNA, 13 bp, Artificial Sequence
  synthetic sequence
tcgcggcagtaca

SEQ ID NO: 16532 - DNA, 13 bp, Artificial Sequence
  synthetic sequence
aagaagccggtgc

SEQ ID NO: 16533 - DNA, 13 bp, Artificial Sequence
  synthetic sequence
acgacgggtcatt

SEQ ID NO: 16534 - DNA, 13 bp, Artificial Sequence
  synthetic sequence
acaccttcaacca

SEQ ID NO: 16535 - DNA, 13 bp, Artificial Sequence
  synthetic sequence
gaacttcacgcgc

SEQ ID NO: 16536 - DNA, 13 bp, Artificial Sequence
  synthetic sequence
ttaaaggatattc

SEQ ID NO: 16537 - DNA, 13 bp, Artificial Sequence
  synthetic sequence
gaaggggaattcg

SEQ ID NO: 16538 - DNA, 13 bp, Artificial Sequence
  synthetic sequence
ctgttgcaccgtc

SEQ ID NO: 16539 - DNA, 13 bp, Artificial Sequence
  synthetic sequence
agggcaccatggt

SEQ ID NO: 16540 - DNA, 13 bp, Artificial Sequence
  synthetic sequence
ccaagccgtgttg

SEQ ID NO: 16541 - DNA, 13 bp, Artificial Sequence
  synthetic sequence
ggcggcgttcttc

SEQ ID NO: 16542 - DNA, 13 bp, Artificial Sequence
  synthetic sequence
ttgctaaggctga

SEQ ID NO: 16543 - DNA, 13 bp, Artificial Sequence
  synthetic sequence
accattgacgcgc

SEQ ID NO: 16544 - DNA, 13 bp, Artificial Sequence
  synthetic sequence
aattgaccgcttg

SEQ ID NO: 16545 - DNA, 13 bp, Artificial Sequence
  synthetic sequence
ccagcccgttagg

SEQ ID NO: 16546 - DNA, 13 bp, Artificial Sequence
  synthetic sequence
cgtgttcgcggtg

SEQ ID NO: 16547 - DNA, 13 bp, Artificial Sequence
  synthetic sequence
gagtttccatgcc

SEQ ID NO: 16548 - DNA, 13 bp, Artificial Sequence
  synthetic sequence
tagcaagcgcatc

SEQ ID NO: 16549 - DNA, 13 bp, Artificial Sequence
  synthetic sequence
gaaagatccacta

SEQ ID NO: 16550 - DNA, 13 bp, Artificial Sequence
  synthetic sequence
gcgctttcttgtt

SEQ ID NO: 16551 - DNA, 13 bp, Artificial Sequence
  synthetic sequence
tcgttacggagtt

SEQ ID NO: 16552 - DNA, 13 bp, Artificial Sequence
  synthetic sequence
ctcgccagcaagc

SEQ ID NO: 16553 - DNA, 13 bp, Artificial Sequence
  synthetic sequence
cccaagtaaccag

SEQ ID NO: 16554 - DNA, 13 bp, Artificial Sequence
  synthetic sequence
gcatcacttcttc

SEQ ID NO: 16555 - DNA, 13 bp, Artificial Sequence
  synthetic sequence
tgattgtcttcat

SEQ ID NO: 16556 - DNA, 13 bp, Artificial Sequence
  synthetic sequence
cgaccaatgcggt

SEQ ID NO: 16557 - DNA, 13 bp, Artificial Sequence
  synthetic sequence
gctgaaggatgtg

SEQ ID NO: 16558 - DNA, 13 bp, Artificial Sequence
  synthetic sequence
gaatccaaatttg

SEQ ID NO: 16559 - DNA, 13 bp, Artificial Sequence
  synthetic sequence
tgttcaataagcc

SEQ ID NO: 16560 - DNA, 13 bp, Artificial Sequence
  synthetic sequence
ttcagccacgcgt

SEQ ID NO: 16561 - DNA, 13 bp, Artificial Sequence
  synthetic sequence
gccaaatcctttg

SEQ ID NO: 16562 - DNA, 13 bp, Artificial Sequence
  synthetic sequence
gcgtggtcagcct

SEQ ID NO: 16563 - DNA, 13 bp, Artificial Sequence
  synthetic sequence
tcacgctgaagaa

SEQ ID NO: 16564 - DNA, 13 bp, Artificial Sequence
  synthetic sequence
agtctgtcactcc

SEQ ID NO: 16565 - DNA, 13 bp, Artificial Sequence
  synthetic sequence
aaggcaatgaaat

SEQ ID NO: 16566 - DNA, 13 bp, Artificial Sequence
  synthetic sequence
aacatggcagaaa

SEQ ID NO: 16567 - DNA, 13 bp, Artificial Sequence
  synthetic sequence
atggattatcagc

SEQ ID NO: 16568 - DNA, 13 bp, Artificial Sequence
  synthetic sequence
acggcctctttgg

SEQ ID NO: 16569 - DNA, 13 bp, Artificial Sequence
  synthetic sequence
tgaaagacgtggc

SEQ ID NO: 16570 - DNA, 13 bp, Artificial Sequence
  synthetic sequence
tcatacttcgcgc

SEQ ID NO: 16571 - DNA, 13 bp, Artificial Sequence
  synthetic sequence
gttcgacgttctc

SEQ ID NO: 16572 - DNA, 13 bp, Artificial Sequence
  synthetic sequence
ccacggtgaaacc

SEQ ID NO: 16573 - DNA, 13 bp, Artificial Sequence
  synthetic sequence
attgtcctgttaa

SEQ ID NO: 16574 - DNA, 13 bp, Artificial Sequence
  synthetic sequence
ctcatattcggca

SEQ ID NO: 16575 - DNA, 13 bp, Artificial Sequence
  synthetic sequence
ccgctgttccacc

SEQ ID NO: 16576 - DNA, 13 bp, Artificial Sequence
  synthetic sequence
gagcatcaaatga

SEQ ID NO: 16577 - DNA, 13 bp, Artificial Sequence
  synthetic sequence
cggcaccatttgg

SEQ ID NO: 16578 - DNA, 13 bp, Artificial Sequence
  synthetic sequence
acctatcaggcga

SEQ ID NO: 16579 - DNA, 13 bp, Artificial Sequence
  synthetic sequence
tgaacattccgct

SEQ ID NO: 16580 - DNA, 13 bp, Artificial Sequence
  synthetic sequence
gaacgtcgagcgc

SEQ ID NO: 16581 - DNA, 13 bp, Artificial Sequence
  synthetic sequence
tctgtctgcgagc

SEQ ID NO: 16582 - DNA, 13 bp, Artificial Sequence
  synthetic sequence
ataaaaggtttgt

SEQ ID NO: 16583 - DNA, 13 bp, Artificial Sequence
  synthetic sequence
ccaaccgagtaac

SEQ ID NO: 16584 - DNA, 13 bp, Artificial Sequence
  synthetic sequence
gttccgatggctt

SEQ ID NO: 16585 - DNA, 13 bp, Artificial Sequence
  synthetic sequence
acttgttcttgcg

SEQ ID NO: 16586 - DNA, 13 bp, Artificial Sequence
  synthetic sequence
cgcaagagttcgg

SEQ ID NO: 16587 - DNA, 13 bp, Artificial Sequence
  synthetic sequence
attttccaatcgt

SEQ ID NO: 16588 - DNA, 13 bp, Artificial Sequence
  synthetic sequence
tatttggtacagt

SEQ ID NO: 16589 - DNA, 13 bp, Artificial Sequence
  synthetic sequence
ggctattctccat

SEQ ID NO: 16590 - DNA, 13 bp, Artificial Sequence
  synthetic sequence
gattttggaaaca

SEQ ID NO: 16591 - DNA, 13 bp, Artificial Sequence
  synthetic sequence
tgttgctgtacag

SEQ ID NO: 16592 - DNA, 13 bp, Artificial Sequence
  synthetic sequence
gcatcaaaccgaa

SEQ ID NO: 16593 - DNA, 13 bp, Artificial Sequence
  synthetic sequence
taaaatgtcatgt

SEQ ID NO: 16594 - DNA, 13 bp, Artificial Sequence
  synthetic sequence
tgttacgaaagac

SEQ ID NO: 16595 - DNA, 13 bp, Artificial Sequence
  synthetic sequence
gcggtgatttaca

SEQ ID NO: 16596 - DNA, 13 bp, Artificial Sequence
  synthetic sequence
gctttcatactga

SEQ ID NO: 16597 - DNA, 13 bp, Artificial Sequence
  synthetic sequence
agcagcttctcgc

SEQ ID NO: 16598 - DNA, 13 bp, Artificial Sequence
  synthetic sequence
ggaccagagatcg

SEQ ID NO: 16599 - DNA, 13 bp, Artificial Sequence
  synthetic sequence
ctgcggtcctcca

SEQ ID NO: 16600 - DNA, 13 bp, Artificial Sequence
  synthetic sequence
tatctgcgacaaa

SEQ ID NO: 16601 - DNA, 13 bp, Artificial Sequence
  synthetic sequence
ttacttggcggat

SEQ ID NO: 16602 - DNA, 13 bp, Artificial Sequence
  synthetic sequence
tggatttatcggc

SEQ ID NO: 16603 - DNA, 13 bp, Artificial Sequence
  synthetic sequence
attggtttgctgc

SEQ ID NO: 16604 - DNA, 13 bp, Artificial Sequence
  synthetic sequence
ttctgaccattgc

SEQ ID NO: 16605 - DNA, 13 bp, Artificial Sequence
  synthetic sequence
ctacattttgtcc

SEQ ID NO: 16606 - DNA, 13 bp, Artificial Sequence
  synthetic sequence
ggtaagcaggcgc

SEQ ID NO: 16607 - DNA, 13 bp, Artificial Sequence
  synthetic sequence
tgcagaatgtcgt

SEQ ID NO: 16608 - DNA, 13 bp, Artificial Sequence
  synthetic sequence
aacaatttcccca

SEQ ID NO: 16609 - DNA, 13 bp, Artificial Sequence
  synthetic sequence
caaggccagtgac

SEQ ID NO: 16610 - DNA, 13 bp, Artificial Sequence
  synthetic sequence
cattcattttcct

SEQ ID NO: 16611 - DNA, 13 bp, Artificial Sequence
  synthetic sequence
tcaagcattttat

SEQ ID NO: 16612 - DNA, 13 bp, Artificial Sequence
  synthetic sequence
ggagcaaagggaa

SEQ ID NO: 16613 - DNA, 13 bp, Artificial Sequence
  synthetic sequence
ctaatactggtgt

SEQ ID NO: 16614 - DNA, 13 bp, Artificial Sequence
  synthetic sequence
atcgcaggccgat

SEQ ID NO: 16615 - DNA, 13 bp, Artificial Sequence
  synthetic sequence
ttcagcgagaaac

SEQ ID NO: 16616 - DNA, 13 bp, Artificial Sequence
  synthetic sequence
gaatcgtaaatat

SEQ ID NO: 16617 - DNA, 13 bp, Artificial Sequence
  synthetic sequence
tttaccgtgtcac

SEQ ID NO: 16618 - DNA, 13 bp, Artificial Sequence
  synthetic sequence
gatcaacggcgtc

SEQ ID NO: 16619 - DNA, 13 bp, Artificial Sequence
  synthetic sequence
cacaggcctgctg

SEQ ID NO: 16620 - DNA, 13 bp, Artificial Sequence
  synthetic sequence
tattatcacgtgt

SEQ ID NO: 16621 - DNA, 13 bp, Artificial Sequence
  synthetic sequence
ggtagcaggctta

SEQ ID NO: 16622 - DNA, 13 bp, Artificial Sequence
  synthetic sequence
tgcgacgatcgga

SEQ ID NO: 16623 - DNA, 13 bp, Artificial Sequence
  synthetic sequence
atctcctatctgg

SEQ ID NO: 16624 - DNA, 13 bp, Artificial Sequence
  synthetic sequence
atagcgggcattg

SEQ ID NO: 16625 - DNA, 13 bp, Artificial Sequence
  synthetic sequence
ttgccagcactga

SEQ ID NO: 16626 - DNA, 13 bp, Artificial Sequence
  synthetic sequence
atgccattgcaaa

SEQ ID NO: 16627 - DNA, 13 bp, Artificial Sequence
  synthetic sequence
tgtctcacggatc

SEQ ID NO: 16628 - DNA, 13 bp, Artificial Sequence
  synthetic sequence
cccatcggaccct

SEQ ID NO: 16629 - DNA, 13 bp, Artificial Sequence
  synthetic sequence
gcgttaaggtttc

SEQ ID NO: 16630 - DNA, 13 bp, Artificial Sequence
  synthetic sequence
caatacgtgatgc

SEQ ID NO: 16631 - DNA, 13 bp, Artificial Sequence
  synthetic sequence
ctctgtcgtcact

SEQ ID NO: 16632 - DNA, 13 bp, Artificial Sequence
  synthetic sequence
gataggcatcgtt

SEQ ID NO: 16633 - DNA, 13 bp, Artificial Sequence
  synthetic sequence
ttcatatctcttc

SEQ ID NO: 16634 - DNA, 13 bp, Artificial Sequence
  synthetic sequence
atcaaacaggtgg

SEQ ID NO: 16635 - DNA, 13 bp, Artificial Sequence
  synthetic sequence
ggacgtggttccc

SEQ ID NO: 16636 - DNA, 13 bp, Artificial Sequence
  synthetic sequence
atttacttagtga

SEQ ID NO: 16637 - DNA, 13 bp, Artificial Sequence
  synthetic sequence
aggtcaaaagcct

SEQ ID NO: 16638 - DNA, 13 bp, Artificial Sequence
  synthetic sequence
gggcaaagagatg

SEQ ID NO: 16639 - DNA, 13 bp, Artificial Sequence
  synthetic sequence
gcctatccacgct

SEQ ID NO: 16640 - DNA, 13 bp, Artificial Sequence
  synthetic sequence
tcgggcttgtgtg

SEQ ID NO: 16641 - DNA, 13 bp, Artificial Sequence
  synthetic sequence
taaatacggtttc

SEQ ID NO: 16642 - DNA, 13 bp, Artificial Sequence
  synthetic sequence
gctcatggagcag

SEQ ID NO: 16643 - DNA, 13 bp, Artificial Sequence
  synthetic sequence
ccggtgaccagca

SEQ ID NO: 16644 - DNA, 13 bp, Artificial Sequence
  synthetic sequence
gtgccttgtcgct

SEQ ID NO: 16645 - DNA, 13 bp, Artificial Sequence
  synthetic sequence
gtcgcaggtgatc

SEQ ID NO: 16646 - DNA, 13 bp, Artificial Sequence
  synthetic sequence
tgctgctggtgga

SEQ ID NO: 16647 - DNA, 13 bp, Artificial Sequence
  synthetic sequence
tttaacgccaatg

SEQ ID NO: 16648 - DNA, 13 bp, Artificial Sequence
  synthetic sequence
ggatatagagaaa

SEQ ID NO: 16649 - DNA, 13 bp, Artificial Sequence
  synthetic sequence
ggttaccctgatc

SEQ ID NO: 16650 - DNA, 13 bp, Artificial Sequence
  synthetic sequence
ttggcacagagga

SEQ ID NO: 16651 - DNA, 13 bp, Artificial Sequence
  synthetic sequence
tttgcgggtcaag

SEQ ID NO: 16652 - DNA, 13 bp, Artificial Sequence
  synthetic sequence
ccattctaagtat

SEQ ID NO: 16653 - DNA, 13 bp, Artificial Sequence
  synthetic sequence
tcccatacagttt

SEQ ID NO: 16654 - DNA, 13 bp, Artificial Sequence
  synthetic sequence
cagcgctacctat

SEQ ID NO: 16655 - DNA, 13 bp, Artificial Sequence
  synthetic sequence
atgcctaatttct

SEQ ID NO: 16656 - DNA, 13 bp, Artificial Sequence
  synthetic sequence
taaagtgctaata

SEQ ID NO: 16657 - DNA, 13 bp, Artificial Sequence
  synthetic sequence
ctccgctttatct

SEQ ID NO: 16658 - DNA, 13 bp, Artificial Sequence
  synthetic sequence
gtgaaacggtaag

SEQ ID NO: 16659 - DNA, 13 bp, Artificial Sequence
  synthetic sequence
ccgccgtattcgt

SEQ ID NO: 16660 - DNA, 13 bp, Artificial Sequence
  synthetic sequence
atttcaaagagcg

SEQ ID NO: 16661 - DNA, 13 bp, Artificial Sequence
  synthetic sequence
ttagcggcagcat

SEQ ID NO: 16662 - DNA, 13 bp, Artificial Sequence
  synthetic sequence
cgttgacgcagcg

SEQ ID NO: 16663 - DNA, 13 bp, Artificial Sequence
  synthetic sequence
ggctcgctgtatg

SEQ ID NO: 16664 - DNA, 13 bp, Artificial Sequence
  synthetic sequence
tacatcctgtaat

SEQ ID NO: 16665 - DNA, 13 bp, Artificial Sequence
  synthetic sequence
cattgatggctgc

SEQ ID NO: 16666 - DNA, 13 bp, Artificial Sequence
  synthetic sequence
gcaacaaattcgt

SEQ ID NO: 16667 - DNA, 13 bp, Artificial Sequence
  synthetic sequence
tatagaatggaca

SEQ ID NO: 16668 - DNA, 13 bp, Artificial Sequence
  synthetic sequence
ttgatgctgctta

SEQ ID NO: 16669 - DNA, 13 bp, Artificial Sequence
  synthetic sequence
cagttaattggaa

SEQ ID NO: 16670 - DNA, 13 bp, Artificial Sequence
  synthetic sequence
ctgggcgagatcg

SEQ ID NO: 16671 - DNA, 13 bp, Artificial Sequence
  synthetic sequence
ttcttcatgaaat

SEQ ID NO: 16672 - DNA, 13 bp, Artificial Sequence
  synthetic sequence
ctggcgtcctgct

SEQ ID NO: 16673 - DNA, 13 bp, Artificial Sequence
  synthetic sequence
tattatcggtgaa

SEQ ID NO: 16674 - DNA, 13 bp, Artificial Sequence
  synthetic sequence
aaagcaaaacaag

SEQ ID NO: 16675 - DNA, 13 bp, Artificial Sequence
  synthetic sequence
agaacttgtgctg

SEQ ID NO: 16676 - DNA, 13 bp, Artificial Sequence
  synthetic sequence
tcagtatgattta

SEQ ID NO: 16677 - DNA, 13 bp, Artificial Sequence
  synthetic sequence
cccctgatgcgac

SEQ ID NO: 16678 - DNA, 13 bp, Artificial Sequence
  synthetic sequence
agcgacattggaa

SEQ ID NO: 16679 - DNA, 13 bp, Artificial Sequence
  synthetic sequence
gtacctataacca

SEQ ID NO: 16680 - DNA, 13 bp, Artificial Sequence
  synthetic sequence
agacagattgcca

SEQ ID NO: 16681 - DNA, 13 bp, Artificial Sequence
  synthetic sequence
gcgcatctggtca

SEQ ID NO: 16682 - DNA, 13 bp, Artificial Sequence
  synthetic sequence
ttgaatattccac

SEQ ID NO: 16683 - DNA, 13 bp, Artificial Sequence
  synthetic sequence
tgtgagctccaag

SEQ ID NO: 16684 - DNA, 13 bp, Artificial Sequence
  synthetic sequence
tacaatgtctcga

SEQ ID NO: 16685 - DNA, 13 bp, Artificial Sequence
  synthetic sequence
aggaggatatttc

SEQ ID NO: 16686 - DNA, 13 bp, Artificial Sequence
  synthetic sequence
gtgtgtaggaact

SEQ ID NO: 16687 - DNA, 13 bp, Artificial Sequence
  synthetic sequence
ggaagagaaactc

SEQ ID NO: 16688 - DNA, 13 bp, Artificial Sequence
  synthetic sequence
ctgaatctgatcc

SEQ ID NO: 16689 - DNA, 13 bp, Artificial Sequence
  synthetic sequence
atgagcgcgatcg

SEQ ID NO: 16690 - DNA, 13 bp, Artificial Sequence
  synthetic sequence
cgcatcgccaatg

SEQ ID NO: 16691 - DNA, 13 bp, Artificial Sequence
  synthetic sequence
aggatcttttccg

SEQ ID NO: 16692 - DNA, 13 bp, Artificial Sequence
  synthetic sequence
cctgctgatcgcc

SEQ ID NO: 16693 - DNA, 13 bp, Artificial Sequence
  synthetic sequence
tttaatgctgttt

SEQ ID NO: 16694 - DNA, 13 bp, Artificial Sequence
  synthetic sequence
gcagctttggatg

SEQ ID NO: 16695 - DNA, 13 bp, Artificial Sequence
  synthetic sequence
gcggaatggtcaa

SEQ ID NO: 16696 - DNA, 13 bp, Artificial Sequence
  synthetic sequence
gcggtggcctatg

SEQ ID NO: 16697 - DNA, 13 bp, Artificial Sequence
  synthetic sequence
ttcaaaacaagaa

SEQ ID NO: 16698 - DNA, 13 bp, Artificial Sequence
  synthetic sequence
gccagcgactgct

SEQ ID NO: 16699 - DNA, 13 bp, Artificial Sequence
  synthetic sequence
atccattggtcgt

SEQ ID NO: 16700 - DNA, 13 bp, Artificial Sequence
  synthetic sequence
ctggcaggaggaa

SEQ ID NO: 16701 - DNA, 13 bp, Artificial Sequence
  synthetic sequence
gctttgtgtttta

SEQ ID NO: 16702 - DNA, 13 bp, Artificial Sequence
  synthetic sequence
tgggtacgattct

SEQ ID NO: 16703 - DNA, 13 bp, Artificial Sequence
  synthetic sequence
tctgctggtatgg

SEQ ID NO: 16704 - DNA, 13 bp, Artificial Sequence
  synthetic sequence
taggtgtttctaa

SEQ ID NO: 16705 - DNA, 13 bp, Artificial Sequence
  synthetic sequence
cattgctcaatga

SEQ ID NO: 16706 - DNA, 13 bp, Artificial Sequence
  synthetic sequence
aacggaggcaatt

SEQ ID NO: 16707 - DNA, 13 bp, Artificial Sequence
  synthetic sequence
taagggcgatctg

SEQ ID NO: 16708 - DNA, 13 bp, Artificial Sequence
  synthetic sequence
tcggtttcctcac

SEQ ID NO: 16709 - DNA, 13 bp, Artificial Sequence
  synthetic sequence
tcatctggttaag

SEQ ID NO: 16710 - DNA, 13 bp, Artificial Sequence
  synthetic sequence
atccaaatatctg

SEQ ID NO: 16711 - DNA, 13 bp, Artificial Sequence
  synthetic sequence
tgaaaattggatg

SEQ ID NO: 16712 - DNA, 13 bp, Artificial Sequence
  synthetic sequence
gcagaacataccg

SEQ ID NO: 16713 - DNA, 13 bp, Artificial Sequence
  synthetic sequence
accgctacgacat

SEQ ID NO: 16714 - DNA, 13 bp, Artificial Sequence
  synthetic sequence
agccagaggcgca

SEQ ID NO: 16715 - DNA, 13 bp, Artificial Sequence
  synthetic sequence
cgggccagttcta

SEQ ID NO: 16716 - DNA, 13 bp, Artificial Sequence
  synthetic sequence
tgataccggatgt

SEQ ID NO: 16717 - DNA, 13 bp, Artificial Sequence
  synthetic sequence
ggaacgaaacgac

SEQ ID NO: 16718 - DNA, 13 bp, Artificial Sequence
  synthetic sequence
tcgttgggcacgt

SEQ ID NO: 16719 - DNA, 13 bp, Artificial Sequence
  synthetic sequence
tcagggaaacctt

SEQ ID NO: 16720 - DNA, 13 bp, Artificial Sequence
  synthetic sequence
ggcccagctgaaa

SEQ ID NO: 16721 - DNA, 13 bp, Artificial Sequence
  synthetic sequence
tcagtacgcattt

SEQ ID NO: 16722 - DNA, 13 bp, Artificial Sequence
  synthetic sequence
caacacgaacggc

SEQ ID NO: 16723 - DNA, 13 bp, Artificial Sequence
  synthetic sequence
agcctgtcttctg

SEQ ID NO: 16724 - DNA, 13 bp, Artificial Sequence
  synthetic sequence
ctgaatagcctaa

SEQ ID NO: 16725 - DNA, 13 bp, Artificial Sequence
  synthetic sequence
ttcccggccgaga

SEQ ID NO: 16726 - DNA, 13 bp, Artificial Sequence
  synthetic sequence
caccatcgcaaat

SEQ ID NO: 16727 - DNA, 13 bp, Artificial Sequence
  synthetic sequence
atgtctcccaccg

SEQ ID NO: 16728 - DNA, 13 bp, Artificial Sequence
  synthetic sequence
caggtgaggccgt

SEQ ID NO: 16729 - DNA, 13 bp, Artificial Sequence
  synthetic sequence
gtatgcaggccag

SEQ ID NO: 16730 - DNA, 13 bp, Artificial Sequence
  synthetic sequence
agaaagagcaacg

SEQ ID NO: 16731 - DNA, 13 bp, Artificial Sequence
  synthetic sequence
tcaaaagaaagaa

SEQ ID NO: 16732 - DNA, 13 bp, Artificial Sequence
  synthetic sequence
tacagaggtgtaa

SEQ ID NO: 16733 - DNA, 13 bp, Artificial Sequence
  synthetic sequence
tcagccattccac

SEQ ID NO: 16734 - DNA, 13 bp, Artificial Sequence
  synthetic sequence
ccctgtgcctaaa

SEQ ID NO: 16735 - DNA, 13 bp, Artificial Sequence
  synthetic sequence
gacgggatctatc

SEQ ID NO: 16736 - DNA, 13 bp, Artificial Sequence
  synthetic sequence
attatttgaagga

SEQ ID NO: 16737 - DNA, 13 bp, Artificial Sequence
  synthetic sequence
tggtgataacaac

SEQ ID NO: 16738 - DNA, 13 bp, Artificial Sequence
  synthetic sequence
acaccacatcaac

SEQ ID NO: 16739 - DNA, 13 bp, Artificial Sequence
  synthetic sequence
tcccgccttttgg

SEQ ID NO: 16740 - DNA, 13 bp, Artificial Sequence
  synthetic sequence
ggccgtcagtagt

SEQ ID NO: 16741 - DNA, 13 bp, Artificial Sequence
  synthetic sequence
gatgaagaagacg

SEQ ID NO: 16742 - DNA, 13 bp, Artificial Sequence
  synthetic sequence
acgcatccattct

SEQ ID NO: 16743 - DNA, 13 bp, Artificial Sequence
  synthetic sequence
cgtactcgcaccg

SEQ ID NO: 16744 - DNA, 13 bp, Artificial Sequence
  synthetic sequence
cagcggcaccttg

SEQ ID NO: 16745 - DNA, 13 bp, Artificial Sequence
  synthetic sequence
atatagcttccaa

SEQ ID NO: 16746 - DNA, 13 bp, Artificial Sequence
  synthetic sequence
gatgcgcgtatag

SEQ ID NO: 16747 - DNA, 13 bp, Artificial Sequence
  synthetic sequence
gggtttcggtgac

SEQ ID NO: 16748 - DNA, 13 bp, Artificial Sequence
  synthetic sequence
ctcatcgcagtat

SEQ ID NO: 16749 - DNA, 13 bp, Artificial Sequence
  synthetic sequence
ctgatcgccgcac

SEQ ID NO: 16750 - DNA, 13 bp, Artificial Sequence
  synthetic sequence
tcggggtgcacga

SEQ ID NO: 16751 - DNA, 13 bp, Artificial Sequence
  synthetic sequence
ggtgtggaaggca

SEQ ID NO: 16752 - DNA, 13 bp, Artificial Sequence
  synthetic sequence
cgattcgctgtat

SEQ ID NO: 16753 - DNA, 13 bp, Artificial Sequence
  synthetic sequence
gtatattgggtta

SEQ ID NO: 16754 - DNA, 13 bp, Artificial Sequence
  synthetic sequence
gcggcattggtcg

SEQ ID NO: 16755 - DNA, 13 bp, Artificial Sequence
  synthetic sequence
aggaacgaaaact

SEQ ID NO: 16756 - DNA, 13 bp, Artificial Sequence
  synthetic sequence
gcaccacaatcgc

SEQ ID NO: 16757 - DNA, 13 bp, Artificial Sequence
  synthetic sequence
ggtattgttgagg

SEQ ID NO: 16758 - DNA, 13 bp, Artificial Sequence
  synthetic sequence
tttagccagtata

SEQ ID NO: 16759 - DNA, 13 bp, Artificial Sequence
  synthetic sequence
ctgataccccatg

SEQ ID NO: 16760 - DNA, 13 bp, Artificial Sequence
  synthetic sequence
agacgttgcagga

SEQ ID NO: 16761 - DNA, 13 bp, Artificial Sequence
  synthetic sequence
aattggaagagaa

SEQ ID NO: 16762 - DNA, 13 bp, Artificial Sequence
  synthetic sequence
acaaaacgccgcc

SEQ ID NO: 16763 - DNA, 13 bp, Artificial Sequence
  synthetic sequence
cgccgttggcatt

SEQ ID NO: 16764 - DNA, 13 bp, Artificial Sequence
  synthetic sequence
tcttgctcgaggc

SEQ ID NO: 16765 - DNA, 13 bp, Artificial Sequence
  synthetic sequence
tggccagcgcatc

SEQ ID NO: 16766 - DNA, 13 bp, Artificial Sequence
  synthetic sequence
ggcgatggaacag

SEQ ID NO: 16767 - DNA, 13 bp, Artificial Sequence
  synthetic sequence
gtagcaaagtgaa

SEQ ID NO: 16768 - DNA, 13 bp, Artificial Sequence
  synthetic sequence
tcgattcggtgct

SEQ ID NO: 16769 - DNA, 13 bp, Artificial Sequence
  synthetic sequence
ttagtaagacgtt

SEQ ID NO: 16770 - DNA, 13 bp, Artificial Sequence
  synthetic sequence
ctcgctggacacg

SEQ ID NO: 16771 - DNA, 13 bp, Artificial Sequence
  synthetic sequence
gcttatttgctct

SEQ ID NO: 16772 - DNA, 13 bp, Artificial Sequence
  synthetic sequence
catctctgtaata

SEQ ID NO: 16773 - DNA, 13 bp, Artificial Sequence
  synthetic sequence
gggaatggatttt

SEQ ID NO: 16774 - DNA, 13 bp, Artificial Sequence
  synthetic sequence
cagaccgtggaaa

SEQ ID NO: 16775 - DNA, 13 bp, Artificial Sequence
  synthetic sequence
caatctgtgcagt

SEQ ID NO: 16776 - DNA, 13 bp, Artificial Sequence
  synthetic sequence
cattattttgatg

SEQ ID NO: 16777 - DNA, 13 bp, Artificial Sequence
  synthetic sequence
gaaatctggccac

SEQ ID NO: 16778 - DNA, 13 bp, Artificial Sequence
  synthetic sequence
tacgacacagcgc

SEQ ID NO: 16779 - DNA, 13 bp, Artificial Sequence
  synthetic sequence
cctaatgtgcttg

SEQ ID NO: 16780 - DNA, 13 bp, Artificial Sequence
  synthetic sequence
tcattccgaatgg

SEQ ID NO: 16781 - DNA, 13 bp, Artificial Sequence
  synthetic sequence
ggcctgttcgcga

SEQ ID NO: 16782 - DNA, 13 bp, Artificial Sequence
  synthetic sequence
ccaatcatcgtta

SEQ ID NO: 16783 - DNA, 13 bp, Artificial Sequence
  synthetic sequence
gccaatgaaaccg

SEQ ID NO: 16784 - DNA, 13 bp, Artificial Sequence
  synthetic sequence
gaatagtgataaa

SEQ ID NO: 16785 - DNA, 13 bp, Artificial Sequence
  synthetic sequence
ggatccatccaaa

SEQ ID NO: 16786 - DNA, 13 bp, Artificial Sequence
  synthetic sequence
gctggtggaagcg

SEQ ID NO: 16787 - DNA, 13 bp, Artificial Sequence
  synthetic sequence
tatccgcttcgac

SEQ ID NO: 16788 - DNA, 13 bp, Artificial Sequence
  synthetic sequence
tttatcacactgc

SEQ ID NO: 16789 - DNA, 13 bp, Artificial Sequence
  synthetic sequence
accatttgtttgg

SEQ ID NO: 16790 - DNA, 13 bp, Artificial Sequence
  synthetic sequence
gatactgctcgtg

SEQ ID NO: 16791 - DNA, 13 bp, Artificial Sequence
  synthetic sequence
ccatcattctcac

SEQ ID NO: 16792 - DNA, 13 bp, Artificial Sequence
  synthetic sequence
ttgctgatgaaaa

SEQ ID NO: 16793 - DNA, 13 bp, Artificial Sequence
  synthetic sequence
gtgaaaccctcag

SEQ ID NO: 16794 - DNA, 13 bp, Artificial Sequence
  synthetic sequence
tcatagtggaacc

SEQ ID NO: 16795 - DNA, 13 bp, Artificial Sequence
  synthetic sequence
gcgaggatcggta

SEQ ID NO: 16796 - DNA, 13 bp, Artificial Sequence
  synthetic sequence
gacgcctcgtcct

SEQ ID NO: 16797 - DNA, 13 bp, Artificial Sequence
  synthetic sequence
gagaggcggtttg

SEQ ID NO: 16798 - DNA, 13 bp, Artificial Sequence
  synthetic sequence
aatacccggaagt

SEQ ID NO: 16799 - DNA, 13 bp, Artificial Sequence
  synthetic sequence
tgcaattcttgaa

SEQ ID NO: 16800 - DNA, 13 bp, Artificial Sequence
  synthetic sequence
aattcgcggcgta

SEQ ID NO: 16801 - DNA, 13 bp, Artificial Sequence
  synthetic sequence
atttcatgtgtgg

SEQ ID NO: 16802 - DNA, 13 bp, Artificial Sequence
  synthetic sequence
aaacaatcctgca

SEQ ID NO: 16803 - DNA, 13 bp, Artificial Sequence
  synthetic sequence
tactgcacccaaa

SEQ ID NO: 16804 - DNA, 13 bp, Artificial Sequence
  synthetic sequence
acagcggcatcgt

SEQ ID NO: 16805 - DNA, 13 bp, Artificial Sequence
  synthetic sequence
gaataaacccgct

SEQ ID NO: 16806 - DNA, 13 bp, Artificial Sequence
  synthetic sequence
gcagttctcaaca

SEQ ID NO: 16807 - DNA, 13 bp, Artificial Sequence
  synthetic sequence
caggtaacgcata

SEQ ID NO: 16808 - DNA, 13 bp, Artificial Sequence
  synthetic sequence
gcagaatgttttc

SEQ ID NO: 16809 - DNA, 13 bp, Artificial Sequence
  synthetic sequence
cgggcattgatga

SEQ ID NO: 16810 - DNA, 13 bp, Artificial Sequence
  synthetic sequence
gctgttggtatca

SEQ ID NO: 16811 - DNA, 13 bp, Artificial Sequence
  synthetic sequence
acgctgtttggca

SEQ ID NO: 16812 - DNA, 13 bp, Artificial Sequence
  synthetic sequence
gactgcgtcacgt

SEQ ID NO: 16813 - DNA, 13 bp, Artificial Sequence
  synthetic sequence
atgatgactctgg

SEQ ID NO: 16814 - DNA, 13 bp, Artificial Sequence
  synthetic sequence
gcaaaagcagtcg

SEQ ID NO: 16815 - DNA, 13 bp, Artificial Sequence
  synthetic sequence
ccctgttagccac

SEQ ID NO: 16816 - DNA, 13 bp, Artificial Sequence
  synthetic sequence
cttgtcgaggatg

SEQ ID NO: 16817 - DNA, 13 bp, Artificial Sequence
  synthetic sequence
aggtaaaaccaat

SEQ ID NO: 16818 - DNA, 13 bp, Artificial Sequence
  synthetic sequence
ctgtcgatcgcgc

SEQ ID NO: 16819 - DNA, 13 bp, Artificial Sequence
  synthetic sequence
aattcttttcgta

SEQ ID NO: 16820 - DNA, 13 bp, Artificial Sequence
  synthetic sequence
cctctttagaagg

SEQ ID NO: 16821 - DNA, 13 bp, Artificial Sequence
  synthetic sequence
tcggtcctcgcaa

SEQ ID NO: 16822 - DNA, 13 bp, Artificial Sequence
  synthetic sequence
cgaaggtcagtgc

SEQ ID NO: 16823 - DNA, 13 bp, Artificial Sequence
  synthetic sequence
cagttgatcgcaa

SEQ ID NO: 16824 - DNA, 13 bp, Artificial Sequence
  synthetic sequence
gcggctcttcagc

SEQ ID NO: 16825 - DNA, 13 bp, Artificial Sequence
  synthetic sequence
gcgacgcagggta

SEQ ID NO: 16826 - DNA, 13 bp, Artificial Sequence
  synthetic sequence
gcagttccttcga

SEQ ID NO: 16827 - DNA, 13 bp, Artificial Sequence
  synthetic sequence
ccatttgcgataa

SEQ ID NO: 16828 - DNA, 13 bp, Artificial Sequence
  synthetic sequence
tttaccagaattg

SEQ ID NO: 16829 - DNA, 13 bp, Artificial Sequence
  synthetic sequence
cagcagatagcag

SEQ ID NO: 16830 - DNA, 13 bp, Artificial Sequence
  synthetic sequence
tcgtcggtctcgg

SEQ ID NO: 16831 - DNA, 13 bp, Artificial Sequence
  synthetic sequence
tttcatgatcagt

SEQ ID NO: 16832 - DNA, 13 bp, Artificial Sequence
  synthetic sequence
ttgaggcaaattc

SEQ ID NO: 16833 - DNA, 13 bp, Artificial Sequence
  synthetic sequence
gtctttattcgta

SEQ ID NO: 16834 - DNA, 13 bp, Artificial Sequence
  synthetic sequence
agctcgacctata

SEQ ID NO: 16835 - DNA, 13 bp, Artificial Sequence
  synthetic sequence
tgcatgtcctgct

SEQ ID NO: 16836 - DNA, 13 bp, Artificial Sequence
  synthetic sequence
accgtggaccacc

SEQ ID NO: 16837 - DNA, 13 bp, Artificial Sequence
  synthetic sequence
tctgtgccattta

SEQ ID NO: 16838 - DNA, 13 bp, Artificial Sequence
  synthetic sequence
cacgaggggaaaa

SEQ ID NO: 16839 - DNA, 13 bp, Artificial Sequence
  synthetic sequence
aaaatgaaatacc

SEQ ID NO: 16840 - DNA, 13 bp, Artificial Sequence
  synthetic sequence
tccttgaagaaga

SEQ ID NO: 16841 - DNA, 13 bp, Artificial Sequence
  synthetic sequence
gccctgctttatc

SEQ ID NO: 16842 - DNA, 13 bp, Artificial Sequence
  synthetic sequence
gaaacgcaaagat

SEQ ID NO: 16843 - DNA, 13 bp, Artificial Sequence
  synthetic sequence
cttcagcttcaag

SEQ ID NO: 16844 - DNA, 13 bp, Artificial Sequence
  synthetic sequence
tttgaagcgataa

SEQ ID NO: 16845 - DNA, 13 bp, Artificial Sequence
  synthetic sequence
cttcctatgttac

SEQ ID NO: 16846 - DNA, 13 bp, Artificial Sequence
  synthetic sequence
tgcccgactgttg

SEQ ID NO: 16847 - DNA, 13 bp, Artificial Sequence
  synthetic sequence
aggggaccatctc

SEQ ID NO: 16848 - DNA, 13 bp, Artificial Sequence
  synthetic sequence
ctcctcgcagtaa

SEQ ID NO: 16849 - DNA, 13 bp, Artificial Sequence
  synthetic sequence
gctctttagggaa

SEQ ID NO: 16850 - DNA, 13 bp, Artificial Sequence
  synthetic sequence
ttgccttaacatt

SEQ ID NO: 16851 - DNA, 13 bp, Artificial Sequence
  synthetic sequence
tactcttgaatac

SEQ ID NO: 16852 - DNA, 13 bp, Artificial Sequence
  synthetic sequence
cgggtatattcaa

SEQ ID NO: 16853 - DNA, 13 bp, Artificial Sequence
  synthetic sequence
gacacggtgacac

SEQ ID NO: 16854 - DNA, 13 bp, Artificial Sequence
  synthetic sequence
tcattaaggtttt

SEQ ID NO: 16855 - DNA, 13 bp, Artificial Sequence
  synthetic sequence
taacaaatagaca

SEQ ID NO: 16856 - DNA, 13 bp, Artificial Sequence
  synthetic sequence
agtccgaccaact

SEQ ID NO: 16857 - DNA, 13 bp, Artificial Sequence
  synthetic sequence
taatctccgtgcg

SEQ ID NO: 16858 - DNA, 13 bp, Artificial Sequence
  synthetic sequence
gggcaggttagtg

SEQ ID NO: 16859 - DNA, 13 bp, Artificial Sequence
  synthetic sequence
cctctaaagcaat

SEQ ID NO: 16860 - DNA, 13 bp, Artificial Sequence
  synthetic sequence
agttgtcacactg

SEQ ID NO: 16861 - DNA, 13 bp, Artificial Sequence
  synthetic sequence
gttctatctccac

SEQ ID NO: 16862 - DNA, 13 bp, Artificial Sequence
  synthetic sequence
tgcgacaccgcca

SEQ ID NO: 16863 - DNA, 13 bp, Artificial Sequence
  synthetic sequence
cgaaatcacccgt

SEQ ID NO: 16864 - DNA, 13 bp, Artificial Sequence
  synthetic sequence
tggcgtaatcggt

SEQ ID NO: 16865 - DNA, 13 bp, Artificial Sequence
  synthetic sequence
ctgccactcgtcg

SEQ ID NO: 16866 - DNA, 13 bp, Artificial Sequence
  synthetic sequence
cggtgtcatgggc

SEQ ID NO: 16867 - DNA, 13 bp, Artificial Sequence
  synthetic sequence
tcgcattcttcgc

SEQ ID NO: 16868 - DNA, 13 bp, Artificial Sequence
  synthetic sequence
gttttgccgctct

SEQ ID NO: 16869 - DNA, 13 bp, Artificial Sequence
  synthetic sequence
gcacatacatacc

SEQ ID NO: 16870 - DNA, 13 bp, Artificial Sequence
  synthetic sequence
tatattctcatcg

SEQ ID NO: 16871 - DNA, 13 bp, Artificial Sequence
  synthetic sequence
ggcactacgaatg

SEQ ID NO: 16872 - DNA, 13 bp, Artificial Sequence
  synthetic sequence
cgcaccgttggga

SEQ ID NO: 16873 - DNA, 13 bp, Artificial Sequence
  synthetic sequence
gccttcaccctgg

SEQ ID NO: 16874 - DNA, 13 bp, Artificial Sequence
  synthetic sequence
ttcgcccaccatg

SEQ ID NO: 16875 - DNA, 13 bp, Artificial Sequence
  synthetic sequence
tgttattctgcgg

SEQ ID NO: 16876 - DNA, 13 bp, Artificial Sequence
  synthetic sequence
gaggccacaacag

SEQ ID NO: 16877 - DNA, 13 bp, Artificial Sequence
  synthetic sequence
tgattttcgctgt

SEQ ID NO: 16878 - DNA, 13 bp, Artificial Sequence
  synthetic sequence
acaattgccagta

SEQ ID NO: 16879 - DNA, 13 bp, Artificial Sequence
  synthetic sequence
tttatctgtatga

SEQ ID NO: 16880 - DNA, 13 bp, Artificial Sequence
  synthetic sequence
acggcgtatggaa

SEQ ID NO: 16881 - DNA, 13 bp, Artificial Sequence
  synthetic sequence
gagcgggaacacg

SEQ ID NO: 16882 - DNA, 13 bp, Artificial Sequence
  synthetic sequence
catcctattcaca

SEQ ID NO: 16883 - DNA, 13 bp, Artificial Sequence
  synthetic sequence
taaccacacgacg

SEQ ID NO: 16884 - DNA, 13 bp, Artificial Sequence
  synthetic sequence
ccgacctgaccaa

SEQ ID NO: 16885 - DNA, 13 bp, Artificial Sequence
  synthetic sequence
agaccaccatcaa

SEQ ID NO: 16886 - DNA, 13 bp, Artificial Sequence
  synthetic sequence
tctgctccatcaa

SEQ ID NO: 16887 - DNA, 13 bp, Artificial Sequence
  synthetic sequence
aacgaaacataat

SEQ ID NO: 16888 - DNA, 13 bp, Artificial Sequence
  synthetic sequence
atgcacggcacgc

SEQ ID NO: 16889 - DNA, 13 bp, Artificial Sequence
  synthetic sequence
taattcttgcatt

SEQ ID NO: 16890 - DNA, 13 bp, Artificial Sequence
  synthetic sequence
cagctgtttatcg

SEQ ID NO: 16891 - DNA, 13 bp, Artificial Sequence
  synthetic sequence
atcaccacaattt

SEQ ID NO: 16892 - DNA, 13 bp, Artificial Sequence
  synthetic sequence
gcaccattaagat

SEQ ID NO: 16893 - DNA, 13 bp, Artificial Sequence
  synthetic sequence
cggccagaactcc

SEQ ID NO: 16894 - DNA, 13 bp, Artificial Sequence
  synthetic sequence
gacgtccgtcgtc

SEQ ID NO: 16895 - DNA, 13 bp, Artificial Sequence
  synthetic sequence
agataagctaacc

SEQ ID NO: 16896 - DNA, 13 bp, Artificial Sequence
  synthetic sequence
tcattgctcacga

SEQ ID NO: 16897 - DNA, 13 bp, Artificial Sequence
  synthetic sequence
taattttgttacg

SEQ ID NO: 16898 - DNA, 13 bp, Artificial Sequence
  synthetic sequence
cagagcatctact

SEQ ID NO: 16899 - DNA, 13 bp, Artificial Sequence
  synthetic sequence
cggcattttgaaa

SEQ ID NO: 16900 - DNA, 13 bp, Artificial Sequence
  synthetic sequence
atcagggagacga

SEQ ID NO: 16901 - DNA, 13 bp, Artificial Sequence
  synthetic sequence
agctctgcactag

SEQ ID NO: 16902 - DNA, 13 bp, Artificial Sequence
  synthetic sequence
gttccgggctttg

SEQ ID NO: 16903 - DNA, 13 bp, Artificial Sequence
  synthetic sequence
atagcaatatggg

SEQ ID NO: 16904 - DNA, 13 bp, Artificial Sequence
  synthetic sequence
caggtcgatgtcg

SEQ ID NO: 16905 - DNA, 13 bp, Artificial Sequence
  synthetic sequence
ttatcttcggcgg

SEQ ID NO: 16906 - DNA, 13 bp, Artificial Sequence
  synthetic sequence
aataagtgttttc

SEQ ID NO: 16907 - DNA, 13 bp, Artificial Sequence
  synthetic sequence
cgccttgagcgtc

SEQ ID NO: 16908 - DNA, 13 bp, Artificial Sequence
  synthetic sequence
ggattggcaaatt

SEQ ID NO: 16909 - DNA, 13 bp, Artificial Sequence
  synthetic sequence
tcgcaccgtacga

SEQ ID NO: 16910 - DNA, 13 bp, Artificial Sequence
  synthetic sequence
gctgtcttgtgcg

SEQ ID NO: 16911 - DNA, 13 bp, Artificial Sequence
  synthetic sequence
tcgccaacggcag

SEQ ID NO: 16912 - DNA, 13 bp, Artificial Sequence
  synthetic sequence
aaacctgctacaa

SEQ ID NO: 16913 - DNA, 13 bp, Artificial Sequence
  synthetic sequence
cgaagcgctcgtc

SEQ ID NO: 16914 - DNA, 13 bp, Artificial Sequence
  synthetic sequence
acggtaagtcccg

SEQ ID NO: 16915 - DNA, 13 bp, Artificial Sequence
  synthetic sequence
aaggtgtcgtggg

SEQ ID NO: 16916 - DNA, 13 bp, Artificial Sequence
  synthetic sequence
tggaaggataatc

SEQ ID NO: 16917 - DNA, 13 bp, Artificial Sequence
  synthetic sequence
ccgatcatcgaca

SEQ ID NO: 16918 - DNA, 13 bp, Artificial Sequence
  synthetic sequence
tgatctccccatt

SEQ ID NO: 16919 - DNA, 13 bp, Artificial Sequence
  synthetic sequence
gttggcgcaaaat

SEQ ID NO: 16920 - DNA, 13 bp, Artificial Sequence
  synthetic sequence
tattctgaagatt

SEQ ID NO: 16921 - DNA, 13 bp, Artificial Sequence
  synthetic sequence
tgctcgaccagcc

SEQ ID NO: 16922 - DNA, 13 bp, Artificial Sequence
  synthetic sequence
gaaaagcttagtg

SEQ ID NO: 16923 - DNA, 13 bp, Artificial Sequence
  synthetic sequence
ctgctggtcgaac

SEQ ID NO: 16924 - DNA, 13 bp, Artificial Sequence
  synthetic sequence
tcttggatcaatg

SEQ ID NO: 16925 - DNA, 13 bp, Artificial Sequence
  synthetic sequence
gcctcgacccgat

SEQ ID NO: 16926 - DNA, 13 bp, Artificial Sequence
  synthetic sequence
cacctccctgaaa

SEQ ID NO: 16927 - DNA, 13 bp, Artificial Sequence
  synthetic sequence
gatgtttatacaa

SEQ ID NO: 16928 - DNA, 13 bp, Artificial Sequence
  synthetic sequence
gaatctgttagct

SEQ ID NO: 16929 - DNA, 13 bp, Artificial Sequence
  synthetic sequence
ctgatttaatgcg

SEQ ID NO: 16930 - DNA, 13 bp, Artificial Sequence
  synthetic sequence
tacggtgaccagg

SEQ ID NO: 16931 - DNA, 13 bp, Artificial Sequence
  synthetic sequence
tagcaccgcgacc

SEQ ID NO: 16932 - DNA, 13 bp, Artificial Sequence
  synthetic sequence
gttaaatatccct

SEQ ID NO: 16933 - DNA, 13 bp, Artificial Sequence
  synthetic sequence
atatttggaacag

SEQ ID NO: 16934 - DNA, 13 bp, Artificial Sequence
  synthetic sequence
tttggctgaagca

SEQ ID NO: 16935 - DNA, 13 bp, Artificial Sequence
  synthetic sequence
atttgcaacagta

SEQ ID NO: 16936 - DNA, 13 bp, Artificial Sequence
  synthetic sequence
ttccgtcacgttc

SEQ ID NO: 16937 - DNA, 13 bp, Artificial Sequence
  synthetic sequence
gcggcgtcaacct

SEQ ID NO: 16938 - DNA, 13 bp, Artificial Sequence
  synthetic sequence
tgcttatggcttt

SEQ ID NO: 16939 - DNA, 13 bp, Artificial Sequence
  synthetic sequence
acacaagaacagc

SEQ ID NO: 16940 - DNA, 13 bp, Artificial Sequence
  synthetic sequence
ccggggaaggctt

SEQ ID NO: 16941 - DNA, 13 bp, Artificial Sequence
  synthetic sequence
cgttttcgcgctg

SEQ ID NO: 16942 - DNA, 13 bp, Artificial Sequence
  synthetic sequence
ccttattcccttt

SEQ ID NO: 16943 - DNA, 13 bp, Artificial Sequence
  synthetic sequence
aatagtaatggct

SEQ ID NO: 16944 - DNA, 13 bp, Artificial Sequence
  synthetic sequence
agattccgcagag

SEQ ID NO: 16945 - DNA, 13 bp, Artificial Sequence
  synthetic sequence
acgggcgtattgt

SEQ ID NO: 16946 - DNA, 13 bp, Artificial Sequence
  synthetic sequence
taccatttcatat

SEQ ID NO: 16947 - DNA, 13 bp, Artificial Sequence
  synthetic sequence
ctggttttacttt

SEQ ID NO: 16948 - DNA, 13 bp, Artificial Sequence
  synthetic sequence
atgaggaactgcc

SEQ ID NO: 16949 - DNA, 13 bp, Artificial Sequence
  synthetic sequence
gctgccgcaattg

SEQ ID NO: 16950 - DNA, 13 bp, Artificial Sequence
  synthetic sequence
caccctccatgtg

SEQ ID NO: 16951 - DNA, 13 bp, Artificial Sequence
  synthetic sequence
gcccttctttaca

SEQ ID NO: 16952 - DNA, 13 bp, Artificial Sequence
  synthetic sequence
cactattttaatc

SEQ ID NO: 16953 - DNA, 13 bp, Artificial Sequence
  synthetic sequence
cccgtggagttcc

SEQ ID NO: 16954 - DNA, 13 bp, Artificial Sequence
  synthetic sequence
aggtgttagctga

SEQ ID NO: 16955 - DNA, 13 bp, Artificial Sequence
  synthetic sequence
aaatgatgaaaca

SEQ ID NO: 16956 - DNA, 13 bp, Artificial Sequence
  synthetic sequence
tgccgacggtgac

SEQ ID NO: 16957 - DNA, 13 bp, Artificial Sequence
  synthetic sequence
gtctcagcggaag

SEQ ID NO: 16958 - DNA, 13 bp, Artificial Sequence
  synthetic sequence
accatatcagtgc

SEQ ID NO: 16959 - DNA, 13 bp, Artificial Sequence
  synthetic sequence
cgcgatcgattcc

SEQ ID NO: 16960 - DNA, 13 bp, Artificial Sequence
  synthetic sequence
ctagtaggtcgca

SEQ ID NO: 16961 - DNA, 13 bp, Artificial Sequence
  synthetic sequence
agatgtgcaggcg

SEQ ID NO: 16962 - DNA, 13 bp, Artificial Sequence
  synthetic sequence
tcctcctctgcca

SEQ ID NO: 16963 - DNA, 13 bp, Artificial Sequence
  synthetic sequence
gtctattatgctt

SEQ ID NO: 16964 - DNA, 13 bp, Artificial Sequence
  synthetic sequence
ttttctgataacg

SEQ ID NO: 16965 - DNA, 13 bp, Artificial Sequence
  synthetic sequence
taccaaagagcta

SEQ ID NO: 16966 - DNA, 13 bp, Artificial Sequence
  synthetic sequence
caatgagttccga

SEQ ID NO: 16967 - DNA, 13 bp, Artificial Sequence
  synthetic sequence
gagaatatttgat

SEQ ID NO: 16968 - DNA, 13 bp, Artificial Sequence
  synthetic sequence
gcccgatttctat

SEQ ID NO: 16969 - DNA, 13 bp, Artificial Sequence
  synthetic sequence
taccaaatcaagc

SEQ ID NO: 16970 - DNA, 13 bp, Artificial Sequence
  synthetic sequence
tatatcatcgaaa

SEQ ID NO: 16971 - DNA, 13 bp, Artificial Sequence
  synthetic sequence
aaacgggtaaggg

SEQ ID NO: 16972 - DNA, 13 bp, Artificial Sequence
  synthetic sequence
gggcagccagtac

SEQ ID NO: 16973 - DNA, 13 bp, Artificial Sequence
  synthetic sequence
tatggcaaagtag

SEQ ID NO: 16974 - DNA, 13 bp, Artificial Sequence
  synthetic sequence
gctaggctgcttt

SEQ ID NO: 16975 - DNA, 13 bp, Artificial Sequence
  synthetic sequence
gcaggaagctgac

SEQ ID NO: 16976 - DNA, 13 bp, Artificial Sequence
  synthetic sequence
gcattcgtcatgg

SEQ ID NO: 16977 - DNA, 13 bp, Artificial Sequence
  synthetic sequence
taaaataaaggcg

SEQ ID NO: 16978 - DNA, 13 bp, Artificial Sequence
  synthetic sequence
tttgacagctgtt

SEQ ID NO: 16979 - DNA, 13 bp, Artificial Sequence
  synthetic sequence
tgacggaagattt

SEQ ID NO: 16980 - DNA, 13 bp, Artificial Sequence
  synthetic sequence
tagttcatgtaga

SEQ ID NO: 16981 - DNA, 13 bp, Artificial Sequence
  synthetic sequence
gtcagcttgtagt

SEQ ID NO: 16982 - DNA, 13 bp, Artificial Sequence
  synthetic sequence
ggttttagccgta

SEQ ID NO: 16983 - DNA, 13 bp, Artificial Sequence
  synthetic sequence
aacccaagagatg

SEQ ID NO: 16984 - DNA, 13 bp, Artificial Sequence
  synthetic sequence
ttttcatcttcac

SEQ ID NO: 16985 - DNA, 13 bp, Artificial Sequence
  synthetic sequence
tatcaggccagct

SEQ ID NO: 16986 - DNA, 13 bp, Artificial Sequence
  synthetic sequence
aataagttctgga

SEQ ID NO: 16987 - DNA, 13 bp, Artificial Sequence
  synthetic sequence
gccattcgacgcg

SEQ ID NO: 16988 - DNA, 13 bp, Artificial Sequence
  synthetic sequence
gtggtgaacttaa

SEQ ID NO: 16989 - DNA, 13 bp, Artificial Sequence
  synthetic sequence
tcgcagggaacac

SEQ ID NO: 16990 - DNA, 13 bp, Artificial Sequence
  synthetic sequence
atttggtaggtgc

SEQ ID NO: 16991 - DNA, 13 bp, Artificial Sequence
  synthetic sequence
caggttgccatcc

SEQ ID NO: 16992 - DNA, 13 bp, Artificial Sequence
  synthetic sequence
ctcgtgcaacatg

SEQ ID NO: 16993 - DNA, 13 bp, Artificial Sequence
  synthetic sequence
cgatctgccgaac

SEQ ID NO: 16994 - DNA, 13 bp, Artificial Sequence
  synthetic sequence
tctccaactatcc

SEQ ID NO: 16995 - DNA, 13 bp, Artificial Sequence
  synthetic sequence
acgcaagattctt

SEQ ID NO: 16996 - DNA, 13 bp, Artificial Sequence
  synthetic sequence
tgcagtgttaatg

SEQ ID NO: 16997 - DNA, 13 bp, Artificial Sequence
  synthetic sequence
gtaaacgtcattt

SEQ ID NO: 16998 - DNA, 13 bp, Artificial Sequence
  synthetic sequence
cttttgaaagtac

SEQ ID NO: 16999 - DNA, 13 bp, Artificial Sequence
  synthetic sequence
tggtgtaaagaaa

SEQ ID NO: 17000 - DNA, 13 bp, Artificial Sequence
  synthetic sequence
gtttcgccattag

SEQ ID NO: 17001 - DNA, 13 bp, Artificial Sequence
  synthetic sequence
atcatgcttaatg

SEQ ID NO: 17002 - DNA, 13 bp, Artificial Sequence
  synthetic sequence
tcatgaagtcgcc

SEQ ID NO: 17003 - DNA, 13 bp, Artificial Sequence
  synthetic sequence
aaatctcctcatc

SEQ ID NO: 17004 - DNA, 13 bp, Artificial Sequence
  synthetic sequence
ttgatgatgccat

SEQ ID NO: 17005 - DNA, 13 bp, Artificial Sequence
  synthetic sequence
ctcttggcggttt

SEQ ID NO: 17006 - DNA, 13 bp, Artificial Sequence
  synthetic sequence
tccatgccggaag

SEQ ID NO: 17007 - DNA, 13 bp, Artificial Sequence
  synthetic sequence
ctgcaccagtgca

SEQ ID NO: 17008 - DNA, 13 bp, Artificial Sequence
  synthetic sequence
tgagtttccatga

SEQ ID NO: 17009 - DNA, 13 bp, Artificial Sequence
  synthetic sequence
tccaattcgtctg

SEQ ID NO: 17010 - DNA, 13 bp, Artificial Sequence
  synthetic sequence
tccaggcgacttc

SEQ ID NO: 17011 - DNA, 13 bp, Artificial Sequence
  synthetic sequence
tctatagtagctg

SEQ ID NO: 17012 - DNA, 13 bp, Artificial Sequence
  synthetic sequence
ttgaccagcgcgc

SEQ ID NO: 17013 - DNA, 13 bp, Artificial Sequence
  synthetic sequence
atcatgagccagt

SEQ ID NO: 17014 - DNA, 13 bp, Artificial Sequence
  synthetic sequence
ttgcgaaatattt

SEQ ID NO: 17015 - DNA, 13 bp, Artificial Sequence
  synthetic sequence
tacgaatgggcac

SEQ ID NO: 17016 - DNA, 13 bp, Artificial Sequence
  synthetic sequence
gatcgagcgatgc

SEQ ID NO: 17017 - DNA, 13 bp, Artificial Sequence
  synthetic sequence
cgctggcgtcaga

SEQ ID NO: 17018 - DNA, 13 bp, Artificial Sequence
  synthetic sequence
caggctttaaacg

SEQ ID NO: 17019 - DNA, 13 bp, Artificial Sequence
  synthetic sequence
tggcttttctgcc

SEQ ID NO: 17020 - DNA, 13 bp, Artificial Sequence
  synthetic sequence
tttacgagtggac

SEQ ID NO: 17021 - DNA, 13 bp, Artificial Sequence
  synthetic sequence
ataaaacggcagg

SEQ ID NO: 17022 - DNA, 13 bp, Artificial Sequence
  synthetic sequence
gaacttgccctgg

SEQ ID NO: 17023 - DNA, 13 bp, Artificial Sequence
  synthetic sequence
gtgatgcgatatc

SEQ ID NO: 17024 - DNA, 13 bp, Artificial Sequence
  synthetic sequence
gacaaatcaactc

SEQ ID NO: 17025 - DNA, 13 bp, Artificial Sequence
  synthetic sequence
ttgctgccacctt

SEQ ID NO: 17026 - DNA, 13 bp, Artificial Sequence
  synthetic sequence
gttcttcgccccg

SEQ ID NO: 17027 - DNA, 13 bp, Artificial Sequence
  synthetic sequence
gggatcaacgcgc

SEQ ID NO: 17028 - DNA, 13 bp, Artificial Sequence
  synthetic sequence
caggccgcttgtc

SEQ ID NO: 17029 - DNA, 13 bp, Artificial Sequence
  synthetic sequence
cttggctactggt

SEQ ID NO: 17030 - DNA, 13 bp, Artificial Sequence
  synthetic sequence
gttgttcttacgt

SEQ ID NO: 17031 - DNA, 13 bp, Artificial Sequence
  synthetic sequence
ccaaatgaaattt

SEQ ID NO: 17032 - DNA, 13 bp, Artificial Sequence
  synthetic sequence
tgtacttgtattg

SEQ ID NO: 17033 - DNA, 13 bp, Artificial Sequence
  synthetic sequence
tcttcgagacgcg

SEQ ID NO: 17034 - DNA, 13 bp, Artificial Sequence
  synthetic sequence
tacatggtgtcga

SEQ ID NO: 17035 - DNA, 13 bp, Artificial Sequence
  synthetic sequence
catttgtaccacc

SEQ ID NO: 17036 - DNA, 13 bp, Artificial Sequence
  synthetic sequence
agtggcaacgcca

SEQ ID NO: 17037 - DNA, 13 bp, Artificial Sequence
  synthetic sequence
gaaccaggcgcac

SEQ ID NO: 17038 - DNA, 13 bp, Artificial Sequence
  synthetic sequence
tttatgggataga

SEQ ID NO: 17039 - DNA, 13 bp, Artificial Sequence
  synthetic sequence
gttgcagcctcaa

SEQ ID NO: 17040 - DNA, 13 bp, Artificial Sequence
  synthetic sequence
taattgcgagccc

SEQ ID NO: 17041 - DNA, 13 bp, Artificial Sequence
  synthetic sequence
taaaggcgatact

SEQ ID NO: 17042 - DNA, 13 bp, Artificial Sequence
  synthetic sequence
tcgagcgcctgca

SEQ ID NO: 17043 - DNA, 13 bp, Artificial Sequence
  synthetic sequence
acttgtagccttt

SEQ ID NO: 17044 - DNA, 13 bp, Artificial Sequence
  synthetic sequence
cgatgggcgtcta

SEQ ID NO: 17045 - DNA, 13 bp, Artificial Sequence
  synthetic sequence
gtcgaaagagcca

SEQ ID NO: 17046 - DNA, 13 bp, Artificial Sequence
  synthetic sequence
cgtccagcaggag

SEQ ID NO: 17047 - DNA, 13 bp, Artificial Sequence
  synthetic sequence
cgatctctattta

SEQ ID NO: 17048 - DNA, 13 bp, Artificial Sequence
  synthetic sequence
tcggcatcgccta

SEQ ID NO: 17049 - DNA, 13 bp, Artificial Sequence
  synthetic sequence
tgactgacctttc

SEQ ID NO: 17050 - DNA, 13 bp, Artificial Sequence
  synthetic sequence
ggtggtcgaggaa

SEQ ID NO: 17051 - DNA, 13 bp, Artificial Sequence
  synthetic sequence
tgatagcgcattg

SEQ ID NO: 17052 - DNA, 13 bp, Artificial Sequence
  synthetic sequence
tatcgatcggccc

SEQ ID NO: 17053 - DNA, 13 bp, Artificial Sequence
  synthetic sequence
acgtcactcacct

SEQ ID NO: 17054 - DNA, 13 bp, Artificial Sequence
  synthetic sequence
tttcaggttggac

SEQ ID NO: 17055 - DNA, 13 bp, Artificial Sequence
  synthetic sequence
ttatggtctggaa

SEQ ID NO: 17056 - DNA, 13 bp, Artificial Sequence
  synthetic sequence
cgcctgaaaggct

SEQ ID NO: 17057 - DNA, 13 bp, Artificial Sequence
  synthetic sequence
tgttcaccataca

SEQ ID NO: 17058 - DNA, 13 bp, Artificial Sequence
  synthetic sequence
ggcttcgaccgca

SEQ ID NO: 17059 - DNA, 13 bp, Artificial Sequence
  synthetic sequence
cctcatcacggct

SEQ ID NO: 17060 - DNA, 13 bp, Artificial Sequence
  synthetic sequence
gttacgcctctgt

SEQ ID NO: 17061 - DNA, 13 bp, Artificial Sequence
  synthetic sequence
aactcaattcaga

SEQ ID NO: 17062 - DNA, 13 bp, Artificial Sequence
  synthetic sequence
gaccagcgcatca

SEQ ID NO: 17063 - DNA, 13 bp, Artificial Sequence
  synthetic sequence
atggcgcagcgga

SEQ ID NO: 17064 - DNA, 13 bp, Artificial Sequence
  synthetic sequence
cgctgcttgagct

SEQ ID NO: 17065 - DNA, 13 bp, Artificial Sequence
  synthetic sequence
cagctcaacgttg

SEQ ID NO: 17066 - DNA, 13 bp, Artificial Sequence
  synthetic sequence
ctggaacagctgc

SEQ ID NO: 17067 - DNA, 13 bp, Artificial Sequence
  synthetic sequence
cggtcttcgcctg

SEQ ID NO: 17068 - DNA, 13 bp, Artificial Sequence
  synthetic sequence
cttcccgtccttg

SEQ ID NO: 17069 - DNA, 13 bp, Artificial Sequence
  synthetic sequence
cgcctgatcaatg

SEQ ID NO: 17070 - DNA, 13 bp, Artificial Sequence
  synthetic sequence
agcgacaaaagat

SEQ ID NO: 17071 - DNA, 13 bp, Artificial Sequence
  synthetic sequence
catatagcatgac

SEQ ID NO: 17072 - DNA, 13 bp, Artificial Sequence
  synthetic sequence
gcttttgtggccg

SEQ ID NO: 17073 - DNA, 13 bp, Artificial Sequence
  synthetic sequence
gtatcgatctgga

SEQ ID NO: 17074 - DNA, 13 bp, Artificial Sequence
  synthetic sequence
ggtcagctgcaac

SEQ ID NO: 17075 - DNA, 13 bp, Artificial Sequence
  synthetic sequence
gacgttcgccttt

SEQ ID NO: 17076 - DNA, 13 bp, Artificial Sequence
  synthetic sequence
cagatgcttttgg

SEQ ID NO: 17077 - DNA, 13 bp, Artificial Sequence
  synthetic sequence
accacacactcgg

SEQ ID NO: 17078 - DNA, 13 bp, Artificial Sequence
  synthetic sequence
agagcccgatgcc

SEQ ID NO: 17079 - DNA, 13 bp, Artificial Sequence
  synthetic sequence
aaggtatcggcta

SEQ ID NO: 17080 - DNA, 13 bp, Artificial Sequence
  synthetic sequence
aaaattcccgcaa

SEQ ID NO: 17081 - DNA, 13 bp, Artificial Sequence
  synthetic sequence
gaaacgcacctat

SEQ ID NO: 17082 - DNA, 13 bp, Artificial Sequence
  synthetic sequence
taacagtttgttc

SEQ ID NO: 17083 - DNA, 13 bp, Artificial Sequence
  synthetic sequence
aaccatttcaccg

SEQ ID NO: 17084 - DNA, 13 bp, Artificial Sequence
  synthetic sequence
cttccggtatcgg

SEQ ID NO: 17085 - DNA, 13 bp, Artificial Sequence
  synthetic sequence
caattggagaagt

SEQ ID NO: 17086 - DNA, 13 bp, Artificial Sequence
  synthetic sequence
cgggacatcagga

SEQ ID NO: 17087 - DNA, 13 bp, Artificial Sequence
  synthetic sequence
tccatgaatcagt

SEQ ID NO: 17088 - DNA, 13 bp, Artificial Sequence
  synthetic sequence
cctagtcttcctg

SEQ ID NO: 17089 - DNA, 13 bp, Artificial Sequence
  synthetic sequence
gacctggtcgcta

SEQ ID NO: 17090 - DNA, 13 bp, Artificial Sequence
  synthetic sequence
tgcgttcaaggaa

SEQ ID NO: 17091 - DNA, 13 bp, Artificial Sequence
  synthetic sequence
tcggtgtcgccga

SEQ ID NO: 17092 - DNA, 13 bp, Artificial Sequence
  synthetic sequence
tcgaacggcttgt

SEQ ID NO: 17093 - DNA, 13 bp, Artificial Sequence
  synthetic sequence
gtcaccttggtca

SEQ ID NO: 17094 - DNA, 13 bp, Artificial Sequence
  synthetic sequence
gcgacttcacaca

SEQ ID NO: 17095 - DNA, 13 bp, Artificial Sequence
  synthetic sequence
ctccaaacaacga

SEQ ID NO: 17096 - DNA, 13 bp, Artificial Sequence
  synthetic sequence
aactcggttaccg

SEQ ID NO: 17097 - DNA, 13 bp, Artificial Sequence
  synthetic sequence
gttatttgcggga

SEQ ID NO: 17098 - DNA, 13 bp, Artificial Sequence
  synthetic sequence
aaggtgtgcgcgt

SEQ ID NO: 17099 - DNA, 13 bp, Artificial Sequence
  synthetic sequence
ttggataaacggg

SEQ ID NO: 17100 - DNA, 13 bp, Artificial Sequence
  synthetic sequence
ttccaaatagcct

SEQ ID NO: 17101 - DNA, 13 bp, Artificial Sequence
  synthetic sequence
gagttgctccata

SEQ ID NO: 17102 - DNA, 13 bp, Artificial Sequence
  synthetic sequence
gatttgtccgaag

SEQ ID NO: 17103 - DNA, 13 bp, Artificial Sequence
  synthetic sequence
acgtcacccggtt

SEQ ID NO: 17104 - DNA, 13 bp, Artificial Sequence
  synthetic sequence
atttatctcccgt

SEQ ID NO: 17105 - DNA, 13 bp, Artificial Sequence
  synthetic sequence
cactggaacctgt

SEQ ID NO: 17106 - DNA, 13 bp, Artificial Sequence
  synthetic sequence
cgccatttatata

SEQ ID NO: 17107 - DNA, 13 bp, Artificial Sequence
  synthetic sequence
ggtccaatcgcag

SEQ ID NO: 17108 - DNA, 13 bp, Artificial Sequence
  synthetic sequence
cttccgtcacaat

SEQ ID NO: 17109 - DNA, 13 bp, Artificial Sequence
  synthetic sequence
atcgcacaaccac

SEQ ID NO: 17110 - DNA, 13 bp, Artificial Sequence
  synthetic sequence
ataaatgcgatga

SEQ ID NO: 17111 - DNA, 13 bp, Artificial Sequence
  synthetic sequence
agcagcgactctg

SEQ ID NO: 17112 - DNA, 13 bp, Artificial Sequence
  synthetic sequence
aacgagaattcag

SEQ ID NO: 17113 - DNA, 13 bp, Artificial Sequence
  synthetic sequence
tctatcatgaatt

SEQ ID NO: 17114 - DNA, 13 bp, Artificial Sequence
  synthetic sequence
cgcagttatctta

SEQ ID NO: 17115 - DNA, 13 bp, Artificial Sequence
  synthetic sequence
cctgcgtcagctt

SEQ ID NO: 17116 - DNA, 13 bp, Artificial Sequence
  synthetic sequence
agccactgcaccg

SEQ ID NO: 17117 - DNA, 13 bp, Artificial Sequence
  synthetic sequence
gcttccatcctcc

SEQ ID NO: 17118 - DNA, 13 bp, Artificial Sequence
  synthetic sequence
gacctggaacatt

SEQ ID NO: 17119 - DNA, 13 bp, Artificial Sequence
  synthetic sequence
cccagattcggcc

SEQ ID NO: 17120 - DNA, 13 bp, Artificial Sequence
  synthetic sequence
cgtggcacaaagt

SEQ ID NO: 17121 - DNA, 13 bp, Artificial Sequence
  synthetic sequence
aacggctttcggc

SEQ ID NO: 17122 - DNA, 13 bp, Artificial Sequence
  synthetic sequence
cggtggagttgcg

SEQ ID NO: 17123 - DNA, 13 bp, Artificial Sequence
  synthetic sequence
gtcaacagaggaa

SEQ ID NO: 17124 - DNA, 13 bp, Artificial Sequence
  synthetic sequence
cttttcaggaata

SEQ ID NO: 17125 - DNA, 13 bp, Artificial Sequence
  synthetic sequence
ctgatttgcgccg

SEQ ID NO: 17126 - DNA, 13 bp, Artificial Sequence
  synthetic sequence
agataaaagaagt

SEQ ID NO: 17127 - DNA, 13 bp, Artificial Sequence
  synthetic sequence
gctgtacagcagc

SEQ ID NO: 17128 - DNA, 13 bp, Artificial Sequence
  synthetic sequence
ccggtggtggtag

SEQ ID NO: 17129 - DNA, 13 bp, Artificial Sequence
  synthetic sequence
agccggcaagcaa

SEQ ID NO: 17130 - DNA, 13 bp, Artificial Sequence
  synthetic sequence
gacatacatgcca

SEQ ID NO: 17131 - DNA, 13 bp, Artificial Sequence
  synthetic sequence
tttctcttcggtg

SEQ ID NO: 17132 - DNA, 13 bp, Artificial Sequence
  synthetic sequence
ttcagaaatgagt

SEQ ID NO: 17133 - DNA, 13 bp, Artificial Sequence
  synthetic sequence
acggcatcgtgct

SEQ ID NO: 17134 - DNA, 13 bp, Artificial Sequence
  synthetic sequence
gaaagattattca

SEQ ID NO: 17135 - DNA, 13 bp, Artificial Sequence
  synthetic sequence
aatgcgcaatttg

SEQ ID NO: 17136 - DNA, 13 bp, Artificial Sequence
  synthetic sequence
agatccttccgga

SEQ ID NO: 17137 - DNA, 13 bp, Artificial Sequence
  synthetic sequence
tgagctttatttg

SEQ ID NO: 17138 - DNA, 13 bp, Artificial Sequence
  synthetic sequence
gtcatcgggtgaa

SEQ ID NO: 17139 - DNA, 13 bp, Artificial Sequence
  synthetic sequence
agcttccatcaac

SEQ ID NO: 17140 - DNA, 13 bp, Artificial Sequence
  synthetic sequence
ctaatatctccaa

SEQ ID NO: 17141 - DNA, 13 bp, Artificial Sequence
  synthetic sequence
tcattttgtgtga

SEQ ID NO: 17142 - DNA, 13 bp, Artificial Sequence
  synthetic sequence
gaaggacgaactg

SEQ ID NO: 17143 - DNA, 13 bp, Artificial Sequence
  synthetic sequence
gcggtcatgtcga

SEQ ID NO: 17144 - DNA, 13 bp, Artificial Sequence
  synthetic sequence
ccatcgtgatgcc

SEQ ID NO: 17145 - DNA, 13 bp, Artificial Sequence
  synthetic sequence
ggcacaatcaagt

SEQ ID NO: 17146 - DNA, 13 bp, Artificial Sequence
  synthetic sequence
tatactggatcgg

SEQ ID NO: 17147 - DNA, 13 bp, Artificial Sequence
  synthetic sequence
aagttcatccaca

SEQ ID NO: 17148 - DNA, 13 bp, Artificial Sequence
  synthetic sequence
tcgaggatattgg

SEQ ID NO: 17149 - DNA, 13 bp, Artificial Sequence
  synthetic sequence
aaggctctcaagg

SEQ ID NO: 17150 - DNA, 13 bp, Artificial Sequence
  synthetic sequence
gacgcccactgct

SEQ ID NO: 17151 - DNA, 13 bp, Artificial Sequence
  synthetic sequence
taacgccgtcgct

SEQ ID NO: 17152 - DNA, 13 bp, Artificial Sequence
  synthetic sequence
tattcccttccaa

SEQ ID NO: 17153 - DNA, 13 bp, Artificial Sequence
  synthetic sequence
acttgatcgggtt

SEQ ID NO: 17154 - DNA, 13 bp, Artificial Sequence
  synthetic sequence
ttgaaccgctgta

SEQ ID NO: 17155 - DNA, 13 bp, Artificial Sequence
  synthetic sequence
ttgctaactcagt

SEQ ID NO: 17156 - DNA, 13 bp, Artificial Sequence
  synthetic sequence
gaagatgcgattg

SEQ ID NO: 17157 - DNA, 13 bp, Artificial Sequence
  synthetic sequence
catccagctcgtc

SEQ ID NO: 17158 - DNA, 13 bp, Artificial Sequence
  synthetic sequence
tattaaacaccct

SEQ ID NO: 17159 - DNA, 13 bp, Artificial Sequence
  synthetic sequence
ggcaagcgaacgt

SEQ ID NO: 17160 - DNA, 13 bp, Artificial Sequence
  synthetic sequence
gatccgaattcgg

SEQ ID NO: 17161 - DNA, 13 bp, Artificial Sequence
  synthetic sequence
ttgcgcggattca

SEQ ID NO: 17162 - DNA, 13 bp, Artificial Sequence
  synthetic sequence
attagacgtccga

SEQ ID NO: 17163 - DNA, 13 bp, Artificial Sequence
  synthetic sequence
acttaccgcagca

SEQ ID NO: 17164 - DNA, 13 bp, Artificial Sequence
  synthetic sequence
aattatcagcatt

SEQ ID NO: 17165 - DNA, 13 bp, Artificial Sequence
  synthetic sequence
ttcacttctcttg

SEQ ID NO: 17166 - DNA, 13 bp, Artificial Sequence
  synthetic sequence
tgcgttgaagtca

SEQ ID NO: 17167 - DNA, 13 bp, Artificial Sequence
  synthetic sequence
gataataatccgt

SEQ ID NO: 17168 - DNA, 13 bp, Artificial Sequence
  synthetic sequence
actttccgcactt

SEQ ID NO: 17169 - DNA, 13 bp, Artificial Sequence
  synthetic sequence
ctgtgatgtataa

SEQ ID NO: 17170 - DNA, 13 bp, Artificial Sequence
  synthetic sequence
cgaataacatgcc

SEQ ID NO: 17171 - DNA, 13 bp, Artificial Sequence
  synthetic sequence
gtcattttattgc

SEQ ID NO: 17172 - DNA, 13 bp, Artificial Sequence
  synthetic sequence
atgcttgccctgg

SEQ ID NO: 17173 - DNA, 13 bp, Artificial Sequence
  synthetic sequence
ttcaagtgtcgtt

SEQ ID NO: 17174 - DNA, 13 bp, Artificial Sequence
  synthetic sequence
tatccatttatgt

SEQ ID NO: 17175 - DNA, 13 bp, Artificial Sequence
  synthetic sequence
accaacggcacca

SEQ ID NO: 17176 - DNA, 13 bp, Artificial Sequence
  synthetic sequence
atggtggcgaccg

SEQ ID NO: 17177 - DNA, 13 bp, Artificial Sequence
  synthetic sequence
tgatacagcgtca

SEQ ID NO: 17178 - DNA, 13 bp, Artificial Sequence
  synthetic sequence
gaaatcattctta

SEQ ID NO: 17179 - DNA, 13 bp, Artificial Sequence
  synthetic sequence
atcaggcagccca

SEQ ID NO: 17180 - DNA, 13 bp, Artificial Sequence
  synthetic sequence
ggcagcagtatct

SEQ ID NO: 17181 - DNA, 13 bp, Artificial Sequence
  synthetic sequence
ctgggccacaata

SEQ ID NO: 17182 - DNA, 13 bp, Artificial Sequence
  synthetic sequence
aaatggcatgggc

SEQ ID NO: 17183 - DNA, 13 bp, Artificial Sequence
  synthetic sequence
cgccacaccaaaa

SEQ ID NO: 17184 - DNA, 13 bp, Artificial Sequence
  synthetic sequence
tgatgaatgcgat

SEQ ID NO: 17185 - DNA, 13 bp, Artificial Sequence
  synthetic sequence
gtctcgcctgcat

SEQ ID NO: 17186 - DNA, 13 bp, Artificial Sequence
  synthetic sequence
caagatcatcggg

SEQ ID NO: 17187 - DNA, 13 bp, Artificial Sequence
  synthetic sequence
cacgctgatggcg

SEQ ID NO: 17188 - DNA, 13 bp, Artificial Sequence
  synthetic sequence
tgtcgcactcatt

SEQ ID NO: 17189 - DNA, 13 bp, Artificial Sequence
  synthetic sequence
tttgatttgcttt

SEQ ID NO: 17190 - DNA, 13 bp, Artificial Sequence
  synthetic sequence
tcctgcgctttga

SEQ ID NO: 17191 - DNA, 13 bp, Artificial Sequence
  synthetic sequence
gctatcgtccggt

SEQ ID NO: 17192 - DNA, 13 bp, Artificial Sequence
  synthetic sequence
acgccgctggaat

SEQ ID NO: 17193 - DNA, 13 bp, Artificial Sequence
  synthetic sequence
cttcctgcccgaa

SEQ ID NO: 17194 - DNA, 13 bp, Artificial Sequence
  synthetic sequence
ctactactttctc

SEQ ID NO: 17195 - DNA, 13 bp, Artificial Sequence
  synthetic sequence
ataaccaacacac

SEQ ID NO: 17196 - DNA, 13 bp, Artificial Sequence
  synthetic sequence
acgctcattggaa

SEQ ID NO: 17197 - DNA, 13 bp, Artificial Sequence
  synthetic sequence
agcctggggttcc

SEQ ID NO: 17198 - DNA, 13 bp, Artificial Sequence
  synthetic sequence
ttggagtagaaag

SEQ ID NO: 17199 - DNA, 13 bp, Artificial Sequence
  synthetic sequence
gctccacggtggt

SEQ ID NO: 17200 - DNA, 13 bp, Artificial Sequence
  synthetic sequence
tgcaggcgaagct

SEQ ID NO: 17201 - DNA, 13 bp, Artificial Sequence
  synthetic sequence
ttggcgcacgcga

SEQ ID NO: 17202 - DNA, 13 bp, Artificial Sequence
  synthetic sequence
agtcaaaacttta

SEQ ID NO: 17203 - DNA, 13 bp, Artificial Sequence
  synthetic sequence
gaaacctcctcgg

SEQ ID NO: 17204 - DNA, 13 bp, Artificial Sequence
  synthetic sequence
agaccgcacactc

SEQ ID NO: 17205 - DNA, 13 bp, Artificial Sequence
  synthetic sequence
cggcaggctggtt

SEQ ID NO: 17206 - DNA, 13 bp, Artificial Sequence
  synthetic sequence
ccaagatcactct

SEQ ID NO: 17207 - DNA, 13 bp, Artificial Sequence
  synthetic sequence
ctgctcacctccg

SEQ ID NO: 17208 - DNA, 13 bp, Artificial Sequence
  synthetic sequence
cgagagtgatccc

SEQ ID NO: 17209 - DNA, 13 bp, Artificial Sequence
  synthetic sequence
aattctacttaca

SEQ ID NO: 17210 - DNA, 13 bp, Artificial Sequence
  synthetic sequence
aacctcttatctt

SEQ ID NO: 17211 - DNA, 13 bp, Artificial Sequence
  synthetic sequence
ttcgtaaacgatg

SEQ ID NO: 17212 - DNA, 13 bp, Artificial Sequence
  synthetic sequence
cagttgatcctgt

SEQ ID NO: 17213 - DNA, 13 bp, Artificial Sequence
  synthetic sequence
taagtgcctcaag

SEQ ID NO: 17214 - DNA, 13 bp, Artificial Sequence
  synthetic sequence
atgcttctttatc

SEQ ID NO: 17215 - DNA, 13 bp, Artificial Sequence
  synthetic sequence
acggtaaatgata

SEQ ID NO: 17216 - DNA, 13 bp, Artificial Sequence
  synthetic sequence
ttctcgccgctga

SEQ ID NO: 17217 - DNA, 13 bp, Artificial Sequence
  synthetic sequence
caatcgtcaactt

SEQ ID NO: 17218 - DNA, 13 bp, Artificial Sequence
  synthetic sequence
ccgcaaccaggat

SEQ ID NO: 17219 - DNA, 13 bp, Artificial Sequence
  synthetic sequence
tcgtacggataaa

SEQ ID NO: 17220 - DNA, 13 bp, Artificial Sequence
  synthetic sequence
tagatcagaaaac

SEQ ID NO: 17221 - DNA, 13 bp, Artificial Sequence
  synthetic sequence
tatgtgcatcagc

SEQ ID NO: 17222 - DNA, 13 bp, Artificial Sequence
  synthetic sequence
tcttcagggttag

SEQ ID NO: 17223 - DNA, 13 bp, Artificial Sequence
  synthetic sequence
agaaatggtgcgt

SEQ ID NO: 17224 - DNA, 13 bp, Artificial Sequence
  synthetic sequence
gtctatgcgcagc

SEQ ID NO: 17225 - DNA, 13 bp, Artificial Sequence
  synthetic sequence
gtccgcgcatcca

SEQ ID NO: 17226 - DNA, 13 bp, Artificial Sequence
  synthetic sequence
acacagtgctggt

SEQ ID NO: 17227 - DNA, 13 bp, Artificial Sequence
  synthetic sequence
ggacagtatgcaa

SEQ ID NO: 17228 - DNA, 13 bp, Artificial Sequence
  synthetic sequence
tcgttaccgctaa

SEQ ID NO: 17229 - DNA, 13 bp, Artificial Sequence
  synthetic sequence
tcttctggtacga

SEQ ID NO: 17230 - DNA, 13 bp, Artificial Sequence
  synthetic sequence
ccagacgcaaatg

SEQ ID NO: 17231 - DNA, 13 bp, Artificial Sequence
  synthetic sequence
gaggcgaacaggg

SEQ ID NO: 17232 - DNA, 13 bp, Artificial Sequence
  synthetic sequence
actgctgcttgct

SEQ ID NO: 17233 - DNA, 13 bp, Artificial Sequence
  synthetic sequence
ctgcgacgagcca

SEQ ID NO: 17234 - DNA, 13 bp, Artificial Sequence
  synthetic sequence
cggtgcttggaaa

SEQ ID NO: 17235 - DNA, 13 bp, Artificial Sequence
  synthetic sequence
cgatcaagtaagg

SEQ ID NO: 17236 - DNA, 13 bp, Artificial Sequence
  synthetic sequence
tgacattacttcc

SEQ ID NO: 17237 - DNA, 13 bp, Artificial Sequence
  synthetic sequence
gcctgctggtgaa

SEQ ID NO: 17238 - DNA, 13 bp, Artificial Sequence
  synthetic sequence
ttttggcgttgag

SEQ ID NO: 17239 - DNA, 13 bp, Artificial Sequence
  synthetic sequence
tcttcgtagctca

SEQ ID NO: 17240 - DNA, 13 bp, Artificial Sequence
  synthetic sequence
atatgactctggc

SEQ ID NO: 17241 - DNA, 13 bp, Artificial Sequence
  synthetic sequence
cacgtagaggccc

SEQ ID NO: 17242 - DNA, 13 bp, Artificial Sequence
  synthetic sequence
tcccgctctcaaa

SEQ ID NO: 17243 - DNA, 13 bp, Artificial Sequence
  synthetic sequence
gacgatcacttcg

SEQ ID NO: 17244 - DNA, 13 bp, Artificial Sequence
  synthetic sequence
tgctgctctacat

SEQ ID NO: 17245 - DNA, 13 bp, Artificial Sequence
  synthetic sequence
cagcagctgtttc

SEQ ID NO: 17246 - DNA, 13 bp, Artificial Sequence
  synthetic sequence
gctttctatatat

SEQ ID NO: 17247 - DNA, 13 bp, Artificial Sequence
  synthetic sequence
tgccattacttcg

SEQ ID NO: 17248 - DNA, 13 bp, Artificial Sequence
  synthetic sequence
tcagcgtaaaatt

SEQ ID NO: 17249 - DNA, 13 bp, Artificial Sequence
  synthetic sequence
accggttattaag

SEQ ID NO: 17250 - DNA, 13 bp, Artificial Sequence
  synthetic sequence
gagagaagtttct

SEQ ID NO: 17251 - DNA, 13 bp, Artificial Sequence
  synthetic sequence
ggcggtacactgt

SEQ ID NO: 17252 - DNA, 13 bp, Artificial Sequence
  synthetic sequence
caccggcgtgtta

SEQ ID NO: 17253 - DNA, 13 bp, Artificial Sequence
  synthetic sequence
agctgccgatccg

SEQ ID NO: 17254 - DNA, 13 bp, Artificial Sequence
  synthetic sequence
tcacaataattgg

SEQ ID NO: 17255 - DNA, 13 bp, Artificial Sequence
  synthetic sequence
ttgccgcagccag

SEQ ID NO: 17256 - DNA, 13 bp, Artificial Sequence
  synthetic sequence
agcgcaggcgtca

SEQ ID NO: 17257 - DNA, 13 bp, Artificial Sequence
  synthetic sequence
attatcactggaa

SEQ ID NO: 17258 - DNA, 13 bp, Artificial Sequence
  synthetic sequence
acacgcgaatatc

SEQ ID NO: 17259 - DNA, 13 bp, Artificial Sequence
  synthetic sequence
gaatgccggtctg

SEQ ID NO: 17260 - DNA, 13 bp, Artificial Sequence
  synthetic sequence
ttggccgcgagat

SEQ ID NO: 17261 - DNA, 13 bp, Artificial Sequence
  synthetic sequence
cgccggtgattgc

SEQ ID NO: 17262 - DNA, 13 bp, Artificial Sequence
  synthetic sequence
gtgtcgccgtagg

SEQ ID NO: 17263 - DNA, 13 bp, Artificial Sequence
  synthetic sequence
caacgataattaa

SEQ ID NO: 17264 - DNA, 13 bp, Artificial Sequence
  synthetic sequence
caccaccattgtc

SEQ ID NO: 17265 - DNA, 13 bp, Artificial Sequence
  synthetic sequence
cccagtgtcagtt

SEQ ID NO: 17266 - DNA, 13 bp, Artificial Sequence
  synthetic sequence
agcgcgtgctgca

SEQ ID NO: 17267 - DNA, 13 bp, Artificial Sequence
  synthetic sequence
acgctcagccttc

SEQ ID NO: 17268 - DNA, 13 bp, Artificial Sequence
  synthetic sequence
ttcgctcgatcca

SEQ ID NO: 17269 - DNA, 13 bp, Artificial Sequence
  synthetic sequence
ggcattaaccccg

SEQ ID NO: 17270 - DNA, 13 bp, Artificial Sequence
  synthetic sequence
tttctaaaggaaa

SEQ ID NO: 17271 - DNA, 13 bp, Artificial Sequence
  synthetic sequence
gtggcgacgccat

SEQ ID NO: 17272 - DNA, 13 bp, Artificial Sequence
  synthetic sequence
ctattaccatgag

SEQ ID NO: 17273 - DNA, 13 bp, Artificial Sequence
  synthetic sequence
cagtgaaattagc

SEQ ID NO: 17274 - DNA, 13 bp, Artificial Sequence
  synthetic sequence
tgtaccccggtgc

SEQ ID NO: 17275 - DNA, 13 bp, Artificial Sequence
  synthetic sequence
taccgaaagcagc

SEQ ID NO: 17276 - DNA, 13 bp, Artificial Sequence
  synthetic sequence
agcttatctctat

SEQ ID NO: 17277 - DNA, 13 bp, Artificial Sequence
  synthetic sequence
agtttctgaattt

SEQ ID NO: 17278 - DNA, 13 bp, Artificial Sequence
  synthetic sequence
cattaaagacttg

SEQ ID NO: 17279 - DNA, 13 bp, Artificial Sequence
  synthetic sequence
ccacgactttccc

SEQ ID NO: 17280 - DNA, 13 bp, Artificial Sequence
  synthetic sequence
ttttacaaagggg

SEQ ID NO: 17281 - DNA, 13 bp, Artificial Sequence
  synthetic sequence
gtactggttccgg

SEQ ID NO: 17282 - DNA, 13 bp, Artificial Sequence
  synthetic sequence
ccctgccgttcct

SEQ ID NO: 17283 - DNA, 13 bp, Artificial Sequence
  synthetic sequence
aaattgattgact

SEQ ID NO: 17284 - DNA, 13 bp, Artificial Sequence
  synthetic sequence
gcgcagtgtgacg

SEQ ID NO: 17285 - DNA, 13 bp, Artificial Sequence
  synthetic sequence
aagtcacttttcg

SEQ ID NO: 17286 - DNA, 13 bp, Artificial Sequence
  synthetic sequence
tggagaacatgct

SEQ ID NO: 17287 - DNA, 13 bp, Artificial Sequence
  synthetic sequence
ttggagcttttaa

SEQ ID NO: 17288 - DNA, 13 bp, Artificial Sequence
  synthetic sequence
gctgtgggtggaa

SEQ ID NO: 17289 - DNA, 13 bp, Artificial Sequence
  synthetic sequence
tatagctcgagca

SEQ ID NO: 17290 - DNA, 13 bp, Artificial Sequence
  synthetic sequence
atcgcctgttcaa

SEQ ID NO: 17291 - DNA, 13 bp, Artificial Sequence
  synthetic sequence
aagatgaagcaaa

SEQ ID NO: 17292 - DNA, 13 bp, Artificial Sequence
  synthetic sequence
ccgccgtgcattg

SEQ ID NO: 17293 - DNA, 13 bp, Artificial Sequence
  synthetic sequence
cggaagtgatagc

SEQ ID NO: 17294 - DNA, 13 bp, Artificial Sequence
  synthetic sequence
ccagcatctgcgt

SEQ ID NO: 17295 - DNA, 13 bp, Artificial Sequence
  synthetic sequence
tttgtagttctgc

SEQ ID NO: 17296 - DNA, 13 bp, Artificial Sequence
  synthetic sequence
gcagctgaccaag

SEQ ID NO: 17297 - DNA, 13 bp, Artificial Sequence
  synthetic sequence
acggtttccggga

SEQ ID NO: 17298 - DNA, 13 bp, Artificial Sequence
  synthetic sequence
tcgatcatcggca

SEQ ID NO: 17299 - DNA, 13 bp, Artificial Sequence
  synthetic sequence
catcttcaccgcc

SEQ ID NO: 17300 - DNA, 13 bp, Artificial Sequence
  synthetic sequence
actgcttgttcta

SEQ ID NO: 17301 - DNA, 13 bp, Artificial Sequence
  synthetic sequence
agctgggctccag

SEQ ID NO: 17302 - DNA, 13 bp, Artificial Sequence
  synthetic sequence
gacgagctgttcg

SEQ ID NO: 17303 - DNA, 13 bp, Artificial Sequence
  synthetic sequence
cagtaccttctcg

SEQ ID NO: 17304 - DNA, 13 bp, Artificial Sequence
  synthetic sequence
gaagaattcactg

SEQ ID NO: 17305 - DNA, 13 bp, Artificial Sequence
  synthetic sequence
tcaacgccgatgg

SEQ ID NO: 17306 - DNA, 13 bp, Artificial Sequence
  synthetic sequence
tttcttcgtttac

SEQ ID NO: 17307 - DNA, 13 bp, Artificial Sequence
  synthetic sequence
tagtcggagcatt

SEQ ID NO: 17308 - DNA, 13 bp, Artificial Sequence
  synthetic sequence
tcattgctgttaa

SEQ ID NO: 17309 - DNA, 13 bp, Artificial Sequence
  synthetic sequence
gggcgtggaactc

SEQ ID NO: 17310 - DNA, 13 bp, Artificial Sequence
  synthetic sequence
tcctatcagccat

SEQ ID NO: 17311 - DNA, 13 bp, Artificial Sequence
  synthetic sequence
accatgagcacgg

SEQ ID NO: 17312 - DNA, 13 bp, Artificial Sequence
  synthetic sequence
ggtcattctgtca

SEQ ID NO: 17313 - DNA, 13 bp, Artificial Sequence
  synthetic sequence
tgacaccactcat

SEQ ID NO: 17314 - DNA, 13 bp, Artificial Sequence
  synthetic sequence
agcggcacggtca

SEQ ID NO: 17315 - DNA, 13 bp, Artificial Sequence
  synthetic sequence
caatcacagcgat

SEQ ID NO: 17316 - DNA, 13 bp, Artificial Sequence
  synthetic sequence
cgctatctcatta

SEQ ID NO: 17317 - DNA, 13 bp, Artificial Sequence
  synthetic sequence
tatgagttgctcg

SEQ ID NO: 17318 - DNA, 13 bp, Artificial Sequence
  synthetic sequence
agtgcaatgtcgt

SEQ ID NO: 17319 - DNA, 13 bp, Artificial Sequence
  synthetic sequence
ccagcggtacgtt

SEQ ID NO: 17320 - DNA, 13 bp, Artificial Sequence
  synthetic sequence
tgctcgaatatgc

SEQ ID NO: 17321 - DNA, 13 bp, Artificial Sequence
  synthetic sequence
gctcagattgctg

SEQ ID NO: 17322 - DNA, 13 bp, Artificial Sequence
  synthetic sequence
ccgcagatgtttg

SEQ ID NO: 17323 - DNA, 13 bp, Artificial Sequence
  synthetic sequence
cacatcaccgttt

SEQ ID NO: 17324 - DNA, 13 bp, Artificial Sequence
  synthetic sequence
tggtccataccgc

SEQ ID NO: 17325 - DNA, 13 bp, Artificial Sequence
  synthetic sequence
acggcccaagctg

SEQ ID NO: 17326 - DNA, 13 bp, Artificial Sequence
  synthetic sequence
ctcgactgcgatg

SEQ ID NO: 17327 - DNA, 13 bp, Artificial Sequence
  synthetic sequence
agaaacaagctta

SEQ ID NO: 17328 - DNA, 13 bp, Artificial Sequence
  synthetic sequence
gattggataatta

SEQ ID NO: 17329 - DNA, 13 bp, Artificial Sequence
  synthetic sequence
agcgacctgatag

SEQ ID NO: 17330 - DNA, 13 bp, Artificial Sequence
  synthetic sequence
ggtgctgtccaag

SEQ ID NO: 17331 - DNA, 13 bp, Artificial Sequence
  synthetic sequence
atcaacaggtatc

SEQ ID NO: 17332 - DNA, 13 bp, Artificial Sequence
  synthetic sequence
tctcggtgcaggg

SEQ ID NO: 17333 - DNA, 13 bp, Artificial Sequence
  synthetic sequence
ctgccttatgttg

SEQ ID NO: 17334 - DNA, 13 bp, Artificial Sequence
  synthetic sequence
cgcggtcttcgta

SEQ ID NO: 17335 - DNA, 13 bp, Artificial Sequence
  synthetic sequence
aacttgtattgca

SEQ ID NO: 17336 - DNA, 13 bp, Artificial Sequence
  synthetic sequence
ctacaatttcttt

SEQ ID NO: 17337 - DNA, 13 bp, Artificial Sequence
  synthetic sequence
tggtggttcacct

SEQ ID NO: 17338 - DNA, 13 bp, Artificial Sequence
  synthetic sequence
tgtgtccaacgat

SEQ ID NO: 17339 - DNA, 13 bp, Artificial Sequence
  synthetic sequence
tgtcgcgtggtgt

SEQ ID NO: 17340 - DNA, 13 bp, Artificial Sequence
  synthetic sequence
tcggatgtgcgct

SEQ ID NO: 17341 - DNA, 13 bp, Artificial Sequence
  synthetic sequence
caggtagtagtct

SEQ ID NO: 17342 - DNA, 13 bp, Artificial Sequence
  synthetic sequence
acgcgatgaacgt

SEQ ID NO: 17343 - DNA, 13 bp, Artificial Sequence
  synthetic sequence
tgccgcaggcgtt

SEQ ID NO: 17344 - DNA, 13 bp, Artificial Sequence
  synthetic sequence
cgctaactcagta

SEQ ID NO: 17345 - DNA, 13 bp, Artificial Sequence
  synthetic sequence
accgggtacgggt

SEQ ID NO: 17346 - DNA, 13 bp, Artificial Sequence
  synthetic sequence
tacacgccgtggc

SEQ ID NO: 17347 - DNA, 13 bp, Artificial Sequence
  synthetic sequence
tgtttccttcact

SEQ ID NO: 17348 - DNA, 13 bp, Artificial Sequence
  synthetic sequence
cctttatatatgt

SEQ ID NO: 17349 - DNA, 13 bp, Artificial Sequence
  synthetic sequence
tgcaatgtctgaa

SEQ ID NO: 17350 - DNA, 13 bp, Artificial Sequence
  synthetic sequence
ttggaacgaaaag

SEQ ID NO: 17351 - DNA, 13 bp, Artificial Sequence
  synthetic sequence
ccaaagcaggaga

SEQ ID NO: 17352 - DNA, 13 bp, Artificial Sequence
  synthetic sequence
aatactcattggt

SEQ ID NO: 17353 - DNA, 13 bp, Artificial Sequence
  synthetic sequence
cacgttgtttgat

SEQ ID NO: 17354 - DNA, 13 bp, Artificial Sequence
  synthetic sequence
taactgcggttag

SEQ ID NO: 17355 - DNA, 13 bp, Artificial Sequence
  synthetic sequence
tgtatggaaaatg

SEQ ID NO: 17356 - DNA, 13 bp, Artificial Sequence
  synthetic sequence
catccccggcact

SEQ ID NO: 17357 - DNA, 13 bp, Artificial Sequence
  synthetic sequence
tgattacgcgctt

SEQ ID NO: 17358 - DNA, 13 bp, Artificial Sequence
  synthetic sequence
ttgtcctgccgct

SEQ ID NO: 17359 - DNA, 13 bp, Artificial Sequence
  synthetic sequence
ttaagcgcttgat

SEQ ID NO: 17360 - DNA, 13 bp, Artificial Sequence
  synthetic sequence
actgtttgccaca

SEQ ID NO: 17361 - DNA, 13 bp, Artificial Sequence
  synthetic sequence
tgttcatattgat

SEQ ID NO: 17362 - DNA, 13 bp, Artificial Sequence
  synthetic sequence
ccagccggatgta

SEQ ID NO: 17363 - DNA, 13 bp, Artificial Sequence
  synthetic sequence
tgaatgtaccgtt

SEQ ID NO: 17364 - DNA, 13 bp, Artificial Sequence
  synthetic sequence
ccactgaaaccga

SEQ ID NO: 17365 - DNA, 13 bp, Artificial Sequence
  synthetic sequence
acctataacaatt

SEQ ID NO: 17366 - DNA, 13 bp, Artificial Sequence
  synthetic sequence
ctccgtcaatacc

SEQ ID NO: 17367 - DNA, 13 bp, Artificial Sequence
  synthetic sequence
agaacaccggagt

SEQ ID NO: 17368 - DNA, 13 bp, Artificial Sequence
  synthetic sequence
taccaggccgatg

SEQ ID NO: 17369 - DNA, 13 bp, Artificial Sequence
  synthetic sequence
attgataaaaccg

SEQ ID NO: 17370 - DNA, 13 bp, Artificial Sequence
  synthetic sequence
aacagatttagcg

SEQ ID NO: 17371 - DNA, 13 bp, Artificial Sequence
  synthetic sequence
tcttggctactgc

SEQ ID NO: 17372 - DNA, 13 bp, Artificial Sequence
  synthetic sequence
ccgaagctgacta

SEQ ID NO: 17373 - DNA, 13 bp, Artificial Sequence
  synthetic sequence
atatacaagccga

SEQ ID NO: 17374 - DNA, 13 bp, Artificial Sequence
  synthetic sequence
gcatcttcatagc

SEQ ID NO: 17375 - DNA, 13 bp, Artificial Sequence
  synthetic sequence
cggcaccttgaac

SEQ ID NO: 17376 - DNA, 13 bp, Artificial Sequence
  synthetic sequence
ccattggggttgg

SEQ ID NO: 17377 - DNA, 13 bp, Artificial Sequence
  synthetic sequence
ccctgttcctttc

SEQ ID NO: 17378 - DNA, 13 bp, Artificial Sequence
  synthetic sequence
caatgacgtgtaa

SEQ ID NO: 17379 - DNA, 55 bp, Artificial Sequence
  synthetic sequence
gccggggtggtgcccatcctggtcgagctggacggcgacgtaaacggccacaagc

SEQ ID NO: 17380 - RNA, 41 nt, Artificial Sequence
  synthetic sequence
uaauuucuacuaaguguagaucgucgccguccagcucgacc

SEQ ID NO: 17381 - DNA, 39 bp, Artificial Sequence
  synthetic sequence
tcctggtcgagctggacggcgacgtaaacggccacaagg

SEQ ID NO: 17382 - RNA, 41 nt, Artificial Sequence; identical to SEQ ID NO: 17380
  synthetic sequence

SEQ ID NO: 17383 - DNA, 59 bp, Artificial Sequence
  synthetic sequence
gataccctagcagaatctctgctgacgcatagatgagacgctggagtacacgtcagcta

---

What is claimed is:

1. A method for characterizing a target DNA present in a sample, the method comprising:

A1) amplifying nucleic acids in the sample using recombinase polymerase amplification;

A2) contacting the sample with:

(a) a type V CRISPR/Cas effector protein; and (b) one or more guide RNAs, wherein the one or more guide RNAs comprise:

i) a region that binds to the type V CRISPR/Cas effector protein; and ii) a guide sequence that hybridizes with the target DNA, wherein said contacting generates a protospacer adjacent motif (PAM)-distal cleavage product comprising a 5' overhang;

B) ligating a double-stranded nucleic acid adapter to the cleavage product, wherein the adapter comprises a 3' deoxyadenosine overhang and a 5' overhang that comprises a stretch of from 3 to 15 contiguous nucleotides that are complementary to a contiguous stretch of nucleotides of the same length in the 5' overhang of the PAM-distal cleavage product, wherein said ligating generates a ligation product comprising the adapter and the PAM-distal cleavage product; and C) determining the nucleotide sequence of the PAM-distal cleavage product present in the ligation product.

2. The method of claim 1, wherein the type V CRISPR/Cas effector protein is a Cas protein selected from the group consisting of a Cas12 protein, a Cas12a (Cpf1) protein, a Cas12b (C2c1) protein, a Cas12d protein, and a Cas14a protein.

3. The method of claim 1, wherein the target DNA is single stranded.

4. The method of claim 1, wherein the target DNA is double stranded.

5. The method of claim 1, wherein the target DNA is viral DNA.

6. The method of claim 5, wherein the target DNA is papovavirus, hepadnavirus, herpesvirus, adenovirus, poxvirus, or parvovirus DNA.

7. The method of claim 1, wherein the target DNA is bacterial DNA.

8. The method of claim 1, wherein the target DNA is from tick-borne pathogen DNA.

9. The method of claim 1, wherein the target DNA is from multiple drug resistant bacterial DNA.

10. The method of claim 1, wherein the target DNA is DNA of a eukaryotic pathogen.

11. The method of claim 10, wherein the eukaryotic pathogen is a pathogenic protozoan, a pathogenic fungus, or a pathogenic helminth.

12. The method of claim 10, wherein the pathogenic protozoan is a *Plasmodium* spp., a *Trypanosoma* spp., a *Trichomonas* spp., an amoeba, a *Giardia* spp., or a *Toxoplama* spp.

13. The method of claim 11, wherein the pathogenic fungus is an *Aspergillus* spp., a *Candida* spp., an *Epidermophyton* spp., a *Histoplasma* spp., or a *Trichphtyon* spp.

14. The method of claim 11, wherein the pathogenic helminth is a nematode or a platyhelminth.

15. The method of claim 11, wherein the pathogenic helminth is selected from the group consisting of an *Ascaris* spp., an *Echinococcus* spp., a *Schistosoma* spp., a *Strongyloides* spp., a *Taenia* spp., and a *Trichinella* spp.

16. The method of claim 1, wherein the target DNA is fetal DNA.

17. The method of claim 1, comprising contacting the sample with 2 or more guide RNAs, wherein the 2 or more guide RNAs differ from one another in the guide sequence.

18. The method of claim 1, wherein the sample comprises a cell.

19. The method of claim 1, wherein the sample is a cell lysate.

20. The method of claim 1, wherein the sample is a cell-free sample.

21. The method of claim 1, wherein the sample is blood, serum, plasma, bronchoalveolar lavage, sputum, urine, cerebrospinal fluid, feces, or a biopsy sample.

22. The method of claim 1, wherein said amplifying comprises contacting the sample with 2 or more sets of primer pairs.

23. The method of claim 1, wherein said amplifying comprises contacting the sample with 1 or more pairs of forward and reverse primers, wherein the 1 or more pairs of forward and reverse primers have sequences selected from the group consisting of SEQ ID Nos: 71 to 6432.

24. The method of claim 1, wherein said amplifying comprises contacting the sample with 1 or more pairs of forward and reverse primers, wherein the 1 or more pairs of forward and reverse primers have sequences selected from the group consisting of SEQ ID Nos: 6433 to 13607.

25. The method of claim 1, wherein said amplifying comprises contacting the sample with 1 or more pairs of forward and reverse primers, wherein the 1 or more pairs of forward and reverse primers have sequences selected from the group consisting of SEQ ID Nos:13608 to 17378.

26. The method of claim 1, wherein sequence determination is carried out by nanopore sequencing.

27. The method of claim 1, wherein the target DNA is present in the sample at a concentration as low as 200 fM.

28. The method of claim 1, further comprising contacting the sample with a detector DNA that is single stranded and does not hybridize with the guide sequence of the guide RNA; and measuring a detectable signal produced by cleavage of the single stranded detector DNA by the type V CRISPR/Cas effector protein, thereby detecting the target DNA.

29. The method of claim 28, wherein the single stranded detector DNA comprises a fluorescence-emitting dye pair.

30. The method of claim 29, wherein the fluorescence-emitting dye pair is a fluorescence resonance energy transfer (FRET) pair.

31. The method of claim 30, wherein the fluorescence-emitting dye pair is a quencher/fluor pair.

32. The method of claim 28, wherein the single stranded detector DNA comprises a modified nucleobase, a modified sugar moiety, and/or a modified nucleic acid linkage.

\* \* \* \* \*